US012760100B2

(12) United States Patent
Chaudhary

(10) Patent No.: US 12,760,100 B2
(45) Date of Patent: Oct. 13, 2026

(54) METHODS AND COMPOSITIONS TO IMPROVE THE SAFETY AND EFFICACY OF CELLULAR THERAPIES

(71) Applicant: University of Southern California, Los Angeles, CA (US)

(72) Inventor: Preet M. Chaudhary, Toluca Lake, CA (US)

( * ) Notice: Subject to any disclaimer, the term of this patent is extended or adjusted under 35 U.S.C. 154(b) by 1167 days.

(21) Appl. No.: 17/423,894

(22) PCT Filed: Jan. 18, 2020

(86) PCT No.: PCT/US2020/014237
§ 371 (c)(1),
(2) Date: Jul. 18, 2021

(87) PCT Pub. No.: WO2020/150702
PCT Pub. Date: Jul. 23, 2020

(65) Prior Publication Data

US 2022/0135678 A1 May 5, 2022

Related U.S. Application Data

(60) Provisional application No. 62/794,506, filed on Jan. 18, 2019.

(51) Int. Cl.

| | |
|---|---|
| ***C07K 16/28*** | (2006.01) |
| ***A61K 40/10*** | (2025.01) |
| ***A61K 40/11*** | (2025.01) |
| ***A61K 40/31*** | (2025.01) |
| ***A61K 40/42*** | (2025.01) |
| ***C07K 16/30*** | (2006.01) |
| ***C12N 15/86*** | (2006.01) |
| *A61K 40/50* | (2025.01) |

(52) U.S. Cl.
CPC .......... *C07K 16/2809* (2013.01); *A61K 40/10* (2025.01); *A61K 40/11* (2025.01); *A61K 40/31* (2025.01); *A61K 40/4202* (2025.01); *A61K 40/421* (2025.01); *A61K 40/4211* (2025.01); *A61K 40/4212* (2025.01); *A61K 40/4215* (2025.01); *A61K 40/4217* (2025.01); *A61K 40/4221* (2025.01); *A61K 40/4251* (2025.01); *A61K 40/4255* (2025.01); *C07K 16/2863* (2013.01); *C07K 16/2875* (2013.01); *C07K 16/2878* (2013.01); *C07K 16/2887* (2013.01); *C07K 16/2893* (2013.01); *C07K 16/3007* (2013.01); *C12N 15/86* (2013.01); *A61K 40/50* (2025.01); *A61K 2239/31* (2023.05); *A61K 2239/38* (2023.05); *C07K 2317/31* (2013.01); *C07K 2317/622* (2013.01)

(58) Field of Classification Search
CPC ........... C07K 16/2809; C07K 16/2863; C07K 16/2875; C07K 16/2878; C07K 16/2887; C07K 16/2893; C07K 16/3007; C07K 2317/31; C07K 2317/622; C07K 16/28; C07K 2319/03; C07K 14/7051; C12N 15/86
See application file for complete search history.

(56) References Cited

U.S. PATENT DOCUMENTS

| | | | |
|---|---|---|---|
| 3,773,919 | A | 11/1973 | Boswell et al. |
| 4,708,871 | A | 11/1987 | Geysen |
| 5,199,942 | A | 4/1993 | Gillis |
| 5,585,089 | A | 12/1996 | Queen et al. |
| 5,660,825 | A | 8/1997 | Sims et al. |
| 5,777,084 | A | 7/1998 | Buhring |
| 5,821,337 | A | 10/1998 | Carter et al. |
| 6,342,220 | B1 | 1/2002 | Adams et al. |
| 6,534,058 | B2 | 3/2003 | Fung et al. |
| 6,703,199 | B1 | 3/2004 | Koide |
| 7,090,843 | B1 | 8/2006 | Francisco et al. |

(Continued)

FOREIGN PATENT DOCUMENTS

| | | |
|---|---|---|
| EP | 0 088 046 A2 | 9/1983 |
| EP | 0 133 988 A2 | 3/1985 |

(Continued)

OTHER PUBLICATIONS

Ruella, M et. al. "Induction of resistance to chimeric antigen receptor T cell therapy by transduction of a single leukemic B cell", 2017, Nature Medicine, 24, 1499-1503. (Year: 2018).*

(Continued)

*Primary Examiner* — Samira J Jean-Louis
*Assistant Examiner* — Alyssa Rae Stonebraker
(74) *Attorney, Agent, or Firm* — IPath, PLC; Steven J. Miller

(57) ABSTRACT

Described herein are novel compositions and methods to improve the safety and efficacy of adoptive cellular therapies of cancer, infection, allergic, degenerative and immune disorders. The disclosure provides a) novel methods and compositions to reduce the accidental insertion of chimeric receptors into cancer cells; b) novel methods to measure the titer of viral vectors; c) novel compositions to generate antigen masking receptors and methods to use such receptors to protect normal cells from immunotherapeutic agents; d) novel compositions and methods to extend the life-span of allogeneic cells, including allogeneic CAR-T cells; e) novel compositions and methods to ameliorate the side-effects of cellular therapies and f) novel compositions of Synthetic Immune Receptors and Ab-TCRs with mutant TCRα constant chains.

26 Claims, 3 Drawing Sheets

Specification includes a Sequence Listing.

(56) References Cited

U.S. PATENT DOCUMENTS

| | | | | |
|---|---|---|---|---|
| 7,109,304 | B2 | 9/2006 | Hansen et al. | |
| 7,112,324 | B1 | 9/2006 | Dorken et al. | |
| 8,263,746 | B2 | 9/2012 | Tesar et al. | |
| 8,323,653 | B2 | 12/2012 | Damschroder et al. | |
| 8,362,211 | B2 | 1/2013 | Elias et al. | |
| 8,394,607 | B2 | 3/2013 | Ebens, Jr. et al. | |
| 8,569,461 | B2 | 10/2013 | Panousis | |
| 8,591,889 | B2 | 11/2013 | Dimitrov et al. | |
| 8,603,477 | B2 | 12/2013 | Afar et al. | |
| 8,624,001 | B1 | 1/2014 | Hansen et al. | |
| 8,652,474 | B2 | 2/2014 | Harris et al. | |
| 10,822,419 | B2 * | 11/2020 | Wang | A61P 35/00 |
| 2002/0041898 | A1 * | 4/2002 | Unger | A61L 29/16 424/178.1 |
| 2003/0129187 | A1 | 7/2003 | Fung et al. | |
| 2005/0025763 | A1 | 2/2005 | Williams et al. | |
| 2009/0297529 | A1 | 12/2009 | Li et al. | |
| 2010/0285037 | A1 | 11/2010 | Abo et al. | |
| 2011/0059090 | A1 | 3/2011 | Revets et al. | |
| 2011/0275787 | A1 | 11/2011 | Kufer et al. | |
| 2012/0269814 | A1 | 10/2012 | Wei et al. | |
| 2013/0095172 | A1 * | 4/2013 | Alavattam | C07K 16/32 530/387.3 |
| 2013/0101607 | A1 | 4/2013 | Kipps et al. | |
| 2014/0322212 | A1 | 10/2014 | Brogdon et al. | |
| 2015/0010585 | A1 | 1/2015 | Goldmakher | |
| 2016/0355590 | A1 | 12/2016 | Epstein | |
| 2018/0127510 | A1 * | 5/2018 | Liaudet-Coopman | A61P 35/00 |
| 2018/0250339 | A1 | 9/2018 | Gill et al. | |

FOREIGN PATENT DOCUMENTS

| | | | | |
|---|---|---|---|---|
| EP | 0 058 481 | B1 | 10/1986 | |
| EP | 0 143 949 | B1 | 10/1988 | |
| EP | 0 036 676 | B2 | 9/1990 | |
| EP | 0 754 230 | B1 | 5/1999 | |
| EP | 0 805 871 | B1 | 11/1999 | |
| EP | 1 616 881 | A1 | 1/2006 | |
| EP | 2 540 741 | A1 | 1/2013 | |
| WO | 93/015722 | A1 | 8/1993 | |
| WO | 95/29697 | A1 | 11/1995 | |
| WO | 2001/12812 | A2 | 2/2001 | |
| WO | 2003/062401 | A2 | 7/2003 | |
| WO | 2004/103404 | A1 | 12/2004 | |
| WO | 2006/084264 | A2 | 8/2006 | |
| WO | 2007/103469 | A2 | 9/2007 | |
| WO | 2009/052431 | A2 | 4/2009 | |
| WO | 2010/015608 | A1 | 2/2010 | |
| WO | 2010/095031 | A2 | 8/2010 | |
| WO | 2011/076922 | A1 | 6/2011 | |
| WO | 2011/159847 | A2 | 12/2011 | |
| WO | 2012/045752 | A1 | 4/2012 | |
| WO | 2012/087962 | A2 | 6/2012 | |
| WO | 2012/138475 | A1 | 10/2012 | |
| WO | 2012/163805 | A1 | 12/2012 | |
| WO | 2012/170785 | A1 | 12/2012 | |
| WO | 2013/059593 | A1 | 4/2013 | |
| WO | 2013/153391 | A1 | 10/2013 | |
| WO | 2013/169625 | A1 | 11/2013 | |
| WO | 2013/173496 | A2 | 11/2013 | |
| WO | 2014/071125 | A1 | 5/2014 | |
| WO | 2014/089354 | A1 | 6/2014 | |
| WO | 2014/153270 | A1 | 9/2014 | |
| WO | 2014/190273 | A1 | 11/2014 | |
| WO | 2015/044386 | A1 | 4/2015 | |
| WO | 2015/052538 | A1 | 4/2015 | |
| WO | 2015/089344 | A1 | 6/2015 | |
| WO | 2015/117229 | A1 | 8/2015 | |
| WO | 2016/014576 | A1 | 1/2016 | |
| WO | 2016/090327 | A2 | 6/2016 | |
| WO | 2016/098356 | A1 | 6/2016 | |
| WO | 2016/187349 | A1 | 11/2016 | |
| WO | WO-2016210447 | A1 * | 12/2016 | A61P 35/00 |
| WO | 2017/021356 | A1 | 2/2017 | |
| WO | 2017/064615 | A1 | 4/2017 | |
| WO | 2017/070608 | A1 | 4/2017 | |
| WO | 2017/172981 | A2 | 10/2017 | |
| WO | 2017/173403 | A1 | 10/2017 | |
| WO | 2017/210689 | A1 | 12/2017 | |
| WO | 2018/053542 | A1 | 3/2018 | |
| WO | 2018/102795 | A2 | 6/2018 | |
| WO | 2018/148443 | A1 | 8/2018 | |
| WO | 2019/067805 | A1 | 4/2019 | |

OTHER PUBLICATIONS

Hombach, A et. al. "An Anti-CD30 Chimeric Receptor That Mediates CD3-Â£-independent T-Cell Activation against Hodgkin's Lymphoma Cells in the Presence of Soluble CD30", 1998, Cancer Research, 58, 1116-1119. (Year: 1998).*

Lamers, CHJ et. al. "Treatment of Metastatic Renal Cell Carcinoma With CAIX CAR-engineered T cells: Clinical Evaluation and Management of On-target Toxicity", 2013, The American Society of Gene & Cell Therapy, 21(4), 904-912. (Year: 2013).*

Goverdhana, S et. al. "Regulatable Gene Expression Systems for Gene Therapy Applications: Progress and Future Challenges", 2005, Mol. Ther., 12(2), 189-211. (Year: 2005).*

Zhao-Emonet, et. al. "T Cell-speci® c expression from Mo-MLV retroviral vectors containing a CD4 mini-promoter/enhancer", 2000, The Journal of Gene Medicine, 2, 416-425. (Year: 2000).*

Cordes, et. al. "Anti-CD19 CARs displayed at the surface of lentiviral vector particles promote transduction of target-expressing cells", Molecular Therapy Methods & Clinical Development, 2021, 21, 42-53. (Year: 2021).*

Li, G et. al. "T cell antigen discovery via trogocytosis", Nature Methods, 2019, 16, 183-190. (Year: 2019).*

Chen et. al. "Viral Vectors for Gene Transfer", Current Protocols in Mouse Biology, 2018, e58, pp. 1-7. (Year: 2018).*

Buchholz et. al. "Surface-Engineered Viral Vectors", Trends in Biotechnology, 2015, 33(12), pp. 777-790. (Year: 2015).*

"BAG36664.1: unnamed protein product [*Homo sapiens*]", GenBank, 2 pages, May 24, 2008.

Altschul et al., "Basic Local Alignment Search Tool", Journal of Molecular Biology, vol. 215, pp. 403-410, 1990.

Altschul et al., "Gapped BLAST and PSI-Blast: A New Generation of Protein Database Search Programs", Nucleic Acids Research, vol. 25, No. 17, pp. 3389-3402, 1997.

Brentjens et al., "Eradication of Systemic B-cell Tumors by Genetically Targeted Human T Lymphocytes Co-stimulated by CD80 and Interleukin-15", Nature Medicine, vol. 9, No. 3, pp. 279-286, Mar. 2003.

Chang et al., "A Chimeric Receptor With NKG2D Specificity Enhances Natural Killer Cell Activation and Killing of Tumor Cells", Cancer Research, vol. 73, No. 6, pp. 1777-1786, 2012.

Chothia et al., "Canonical Structures for the Hypervariable Regions of Immunoglobulins", Journal of Molecular Biology, vol. 196, pp. 901-917, 1987.

Cooper et al., "T-cell Clones can be Rendered Specific for CD19: Toward the Selective Augmentation of the Graft-versus-b-lineage Leukemia Effect", Blood, vol. 101, No. 4, pp. 1637-1644, Feb. 15, 2003.

Eppstein et al., "Biological Activity of Liposome-encapsulated Murine Interferon Gamma is Mediated by a Cell Membrane Receptor", Proceedings of the National Academy of Sciences USA, vol. 82, pp. 3688-3692, Jun. 1985.

Geiger et al., "The TCR ζ -Chain Immunoreceptor Tyrosine-Based Activation Motifs Are Sufficient for the Activation and Differentiation of Primary T Lymphocytes", The Journal of Immunology, vol. 162, pp. 5931-5939, 1999.

Geysen et al., "Small Peptides Induce Antibodies With a Sequence and Structural Requirement for Binding Antigen Comparable to Antibodies Raised Against the Native Protein", Proceedings of the National Academy of Sciences USA, vol. 82, pp. 178-182, Jan. 1985.

(56) References Cited

OTHER PUBLICATIONS

Geysen et al., "Use of Peptide Synthesis to Probe Viral Antigens for Epitopes to a Resolution of a Single Amino Acid", Proceedings of the National Academy of Sciences USA, vol. 81, pp. 3998-4002, Jul. 1984.
Green et al., "Molecular Cloning: A Laboratory Manual" Cold Spring Harbor Laboratory Press, 4th Edition, vol. 1, 34 pages, 2012.
Holliger et al., "Engineered Antibody Fragments and the Rise of Single Domains", Nature Biotechnology, vol. 23, No. 9, pp. 1126-1136, Sep. 2005.
Hopp et al., "Prediction of Protein Antigenic Determinants From Amino Acid Sequences", Proceedings of the National Academy of Sciences USA, vol. 78, No. 6, pp. 3824-3828, Jun. 1981.
Iwai et al., "PD-1 Blockade Inhibits Hematogenous Spread of Poorly Immunogenic Tumor Cells by Enhanced Recruitment of Effector T Cells", International Immunology, vol. 17, No. 2, pp. 133-144, Dec. 20, 2004.
Kabat et al., "Sequences of Proteins of Immunological Interest", U.S. Dept. of Health and Human Services, vol. 1, 1246 pages, 1991.
Kabat et al., "Unusual Distributions of Amino Acids in Complementarity-determining (Hypervariable) Segments of Heavy and Light Chains of Immunoglobulins and Their Possible Roles in Specificity of Antibody-combining Sites", Journal of Biological Chemistry, vol. 252, No. 19, pp. 6609-6616, Oct. 10, 1977.
Kohler et a., "Derivation of Specific Antibody-producing Tissue Culture and Tumor Lines by Cell Fusion", European Journal of Immunology, vol. 6, pp. 511-519, 1976.
Kudo et al., "T Lymphocytes Expressing a CD16 Signaling Receptor Exert Antibody-dependent Cancer Cell Killing", Cancer Research, vol. 74, No. 1, pp. 93-103, 2013.
Kyte et al., "A Simple Method for Displaying the Hydropathic Character of a Protein", Journal of Molecular Biology, vol. 157, pp. 105-132, 1982.
Langer et al., "Biocompatibility of Polymeric Delivery Systems for Macromolecules", Journal of Biomedical Materials Research, vol. 15, pp. 267-277, 1981.
Lee et al., "Current Concepts in the Diagnosis and Management of Cytokine Release Syndrome", Blood, vol. 124, No. 2, pp. 188-195, 2014.
Matta et al., "Use of Lentiviral Vectors for Delivery of Small Interfering RNA", Cancer Biology & Therapy, vol. 2, No. 2, pp. 206-210, Mar./Apr. 2003.
Meyer et al., "Antimicrobial Preservative Use in Parenteral Products: Past and Present", Journal of Pharmaceutical Sciences, vol. 96, No. 12, pp. 3155-3167, 2007.
Miller et al., "Successful Adoptive Transfer and in Vivo Expansion of Human Haploidentical Nk Cells in Patients With Cancer". Blood, vol. 105, pp. 3051-3057, 2005.
Miller, Jeffrey S. "Therapeutic Applications: Natural Killer Cells in the Clinic", Hematology, pp. 247-253, 2013.
Milone et al., "Chimeric Receptors Containing CD137 Signal Transduction Domains Mediate Enhanced Survival of T Cells and Increased Antileukemic Efficacy in Vivo", Molecular Therapy, vol. 17, No. 8, pp. 1453-1464, Aug. 2009.
Myers et al., "Optimal alignments in linear space" Computer Application Bioscience, vol. 4, No., 1, pp. 11-17, 1988.
Needleman et al., "A general method applicable to the search for similarities in the amino acid sequence of two proteins", J. Mol. Bioi. vol. 48, pp. 443-453, 1970.
Nicolaou et al., "Calicheamicin θ1: A Rationally Designed Molecule with Extremely Potent and Selective DNA Cleaving Properties and Apoptosis Inducing Activity", Angewandte Chemie International Edition in English, vol. 33, No. 2, pp. 183-186, 1994.
Pardoll, Drew M. "The Blockade of Immune Checkpoints in Cancer Immunotherapy", Nature Reviews Cancer, vol. 12, pp. 252-264, Apr. 2012.
Pearson et al., "Improved Tools for Biological Sequence Comparison", Proceedings of the National Academy of Sciences USA, vol. 85, pp. 2444-2448, Apr. 1988.
Rubnitz et al., "NKAML: a Pilot Study to Determine the Safety and Feasibility of Haploidentical Natural Killer Cell Transplantation in Childhood Acute Myeloid Leukemia", Journal of Clinical Oncology, vol. 28, No. 6, pp. 955-959, Feb. 20, 2010.
Sharma et al., "Novel Cancer Immunotherapy Agents With Survival Benefit: Recent Successes and Next Steps", Nature Reviews Cancer, vol. 11, pp. 805-812, Nov. 2011.
Sidman et al., "Controlled Release of Macromolecules and Pharmaceuticals from Synthetic Polypeptides Based on Glutamic Acid ", Biopolymers, vol. 22, pp. 547-556, 1983.
Torikai et al., "A foundation for universal T-cell based immunotherapy: T cells engineered to express a CD19-specific chimeric-antigen-receptor and eliminate expression of endogenous TCR", Blood, vol. 119, No. 24, 19 pages, Jun. 14, 2012.
Vivier et al., "Innate or Adaptive Immunity? The Example of Natural Killer Cells", Science, vol. 331, No. 6013, 14 pages, Jan. 7, 2011.
Wu et al., "Remote Control of Therapeutic T Cells Through a Small Molecule-gated Chimeric Receptor", Science, vol. 350, No. 6258, 11 pages, Oct. 16, 2015.
Ruella et al., "Induction of resistance to chimeric antigen receptor T cell therapy by transduction of a single leukemic B cell", Nat Med., Oct. 1, 2018, vol. 24, No. 10, pp. 1499-1503.
Young, Lee, International Search Report and Written Opinion, PCT/US20/14237, International Searching Authority, United States Patent and Trademark Office, Jun. 11, 2020.
Bipulendu et al., "Chimeric Antigen Receptor (CAR)-Specific Monoclonal Antibody to Detect CD19-Specific T Cells in Clinical Trials", Plos One, Mar. 1, 2023, vol. 8, No. 3, pp. e57838.
Cordes et al., "Anti-CD19 CARs displayed at the surface of lentiviral vector particles promote transduction of target-expressing cells", Molecular Therapy—Methods & Clinical Development, Jun. 1, 2021, vol. 21, pp. 42-53.
Levine et al., "Global Manufacturing of CAR T Cell Therapy", Molecular Therapy—Methods & Clinical Development, Mar. 4, 2017, vol. 4, pp. 92-101.
Perez-Mato, Isabel, European Search Report, European Patent Office, Application No. 20741799.9, Dec. 23, 2022.
Ruella et al., "A cellular antidote to specifically deplete anti-CD19 chimeric antigen receptor-positive cells", Blood Brief Report, Immunobiology and Immunotherapy, Feb. 13, 2020, vol. 135, No. 7, pp. 505-509.
Wang et al., "Clinical manufacturing of CAR T cells: foundation of a promising therapy", Molecular Therapy—Oncolytics, Jan. 1, 2016, vol. 3, p. 16015.

* cited by examiner

METHODS AND COMPOSITIONS TO IMPROVE THE SAFETY AND EFFICACY OF CELLULAR THERAPIES

CROSS REFERENCE TO RELATED APPLICATIONS

This application is a U.S. National Phase Application filed under 35 U.S.C. § 371 and claim priority to International Application No. PCT/US2020/014237, filed Jan. 18, 2020, which application claims priority to U.S. Provisional Application Ser. No. 62/794,506, filed Jan. 18, 2019, the disclosures of which are incorporated herein by reference.

STATEMENT REGARDING FEDERALLY SPONSORED RESEARCH

This invention was made with government support under the Grant No. DE025804, awarded by the National Institutes of Health. The government has certain rights in the invention.

TECHNICAL FIELD

The disclosure provides compositions and methods to improve the safety and efficacy of adoptive cellular therapies of cancer, infection, allergic, degenerative and immune disorders. The disclosure provides methods and compositions to reduce the accidental insertion of chimeric antigen receptors into a cell, such as a cancer cell. The disclosure provides methods to measure the titer of viral vectors. The disclosure also provides compositions to generate antigen masking receptors (AMR) and methods to use such receptors to protect normal cells, including stem cells and T cells, from immunotherapeutic agents, including CAR-T cells and bispecific T cell engagers. The disclosure also provides compositions and methods to extend the life-span of allogeneic cells, including allogeneic CAR-T cells. The disclosure provides compositions and methods to ameliorate the side-effects of cellular therapies, including CAR-T cells and bispecific T cell engagers. The disclosure also relates to methods of using drugs, e.g. antibodies such as e.g. anti-C5 antibodies, that are capable of inhibiting the complement pathway for use in treating cellular therapies (e.g., CAR-T cells, Bispecific T cell engagers) associated side effects, such as CRS and neurological complications (e.g., CRES or CAR-related encephalopathy syndrome), in a subject in need thereof. Finally, the disclosure provides compositions of next generation CAR-T cells, including Synthetic Immune Receptors and Ab-TCRs with mutant TCRα constant chains.

INCORPORATION BY REFERENCE OF SEQUENCE LISTING

Accompanying this filing is a Sequence Listing entitled "Sequence-Listing_ST25.txt", created on Jan. 18, 2020 and having 37,318,909 bytes of data, machine formatted on IBM-PC, MS-Windows operating system. The sequence listing is hereby incorporated herein by reference in its entirety for all purposes.

BACKGROUND

Adoptive immunotherapy has risen to the forefront of treatment approaches for cancer. T cells can be engineered to express the genes of chimeric antigen receptors (CARs) that recognize tumor associated antigens. CARs are engineered immune-receptors, which can redirect T cells to selectively kill tumor cells. The general premise for their use in cancer immunotherapy is to rapidly generate tumor-targeted T cells, bypassing the barriers and incremental kinetics of active immunization and thereby act as 'living drugs'. Unlike the physiologic T-cell receptor (TCR), which engages HLA-peptide complexes, CARs engage molecules that do not require peptide processing or HLA expression to be recognized. CARs therefore recognize antigen on any HLA background, in contrast to TCRs, which need to be matched to the haplotype of the patient. Furthermore, CARs can target tumor cells that have down-regulated HLA expression or proteasomal antigen processing, two mechanisms that contribute to tumor escape from TCR-mediated immunity. Another feature of the broad applicability of CARs is their ability to bind not only to proteins but also to carbohydrate and glycolipid structures, again expanding the range of potential targets.

Chimeric Antigen Receptor-T (CAR-T) cell immunotherapy has produced dramatic responses against a number of hematologic malignancies and has been approved for the treatment of ALL and B cell lymphoma. Despite the successes, the CAR-T constructs in current use have several limitations. These limitations include disease relapse, high manufacturing cost, and toxicities, including cytokine release syndrome, neurotoxicity and toxicity on normal healthy organs and tissues.

SUMMARY

The disclosure provides a composition comprising (i) a retroviral vector comprising a polynucleotide encoding an antigen binding receptor (ABR) construct targeting an antigen; and (ii) an inhibitor agent that prevents the interaction of an antigen binding domain that binds to the antigen. In one embodiment, the inhibitory agent is a soluble cognate of the antigen binding domain. In another embodiment, the inhibitory agent is a soluble binding domain having a specificity to the same antigen. In yet another embodiment, the inhibitory agent comprises an antibody, a Fv, a Fab, a (Fab')2, a heavy chain variable region of an antibody (vH domain), a light chain variable region of an antibody (vL domain), a single domain antibody, a single chain variable fragment (scFv), a monomeric variable region of an antibody, a camelid vHH domain, a non-immunoglobulin antigen binding domain (e.g., DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein), a ligand or a fragment thereof having specificity to the same antigen. In still another embodiment, the retroviral vector comprises a lipid envelop containing the antigen binding receptor construct. In another embodiment, the antigen-binding domain construct comprises a chimeric antigen receptor. In another embodiment, the ABR is an antigen masking receptor (AMR) and comprises an antigen binding domain, an optional hinge domain, a localization domain and an optional protein stabilization or destabilization domain. In yet another embodiment, the ABR is an antigen masking receptor (AMR) and comprises an antigen binding domain, an optional hinge domain and a membrane anchoring or a transmembrane domain and an optional protein stabilization or destabilization domain. In a further embodiment, the antigen binding domain of AMR comprises (1) an antibody; (2) an antibody fragment; (3) a heavy chain variable region of an antibody (vH domain) or a fragment thereof; (4) a light chain variable region of an antibody (vL domain) or a fragment thereof; (5) a single chain variable fragment (scFv) or a fragment thereof; (6) a single domain antibody (SDAB) or a fragment thereof; (7) a camelid VHH domain or a fragment thereof; (8) a monomeric variable region of an antibody; (9) a non-immunoglobulin antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) a receptor; and/or (11) a ligand. In another embodiment, the localization domain of the antigen masking receptor (AMR) comprises an endoplasmic reticulum (ER) or Golgi retention sequence; a proteosome localizing sequence; a GPI linker; a transmembrane domain sequence derived from CD8a, 4-1BB, CD28, CD34, CD4, CD16, OX40, CD3ζ, CD3ε, CD3γ, CD3δ, TCRa, CD32, CD64, VEGFR2, FAS, or FGFR2B. In yet another embodiment, the antigen masked by the antigen masking receptor (AMR) comprises one or more of CD33, CD123, MPL, CD19, CD22, CD20, BCMA, CS1, FLT3, CSF2RA, IL6R, LAMP1, TSLRP, CD4, CXCR4, GPC3, CD45, CD44v, CD43, CD32, CD38, CD79b, CD138, CD179b, CD70, Folate Receptor beta, WT1, NY-ESO1, CLL1, IL1Ra, CLEC5A, PR1, TGFbeta, ROR1, TnAg, CD200R, Kappa Light Chain, TCRβ1 constant chain, TCRβ2 constant chain, TCRα constant chain, TCRγ, TCRδ, CD5, CD52, CD7, CD3ε, IL1RAP, Lym1, Lym2 and/or BST1/CD157. In another embodiment, the AMR carries a protein stabilization or a protein destabilization domain and expression and activity of the AMR is regulated in a reversible manner by administration of a ligand. In a further embodiment, the protein destabilization domain is dTAG and the expression and activity of the AMR is regulated in a reversible manner by administration of dTAG-13, dTAG-7 or one of their analogs. In another or further embodiment, the protein destabilization domain is ShieldTAG and the expression and activity of the AMR is regulated in a reversible manner by administration of Shield-1 or one of its analogs.

The disclosure also provide a method for inhibiting the accidental insertion of an antigen binding receptor construct into a cell expressing an antigen that is targeted by the antigen binding receptor comprising contacting the cell with the composition or an embodiment thereof as described in the paragraph above. In one embodiment, the contacting is ex vivo. In yet another or further embodiment, the cell is a disease-causing or disease-associated cell. In yet another embodiment, the composition inhibits the binding of an antigen binding receptor construct on the surface of the retroviral vector with an antigen on the cell. In a further embodiment, the cell is a cancer cell.

The disclosure also provides a method for inhibiting the accidental insertion of an antigen binding receptor construct into a cell expressing an antigen that is targeted by the antigen binding receptor comprising contacting the cell with inhibitor agent that prevents the interaction of an antigen binding domain that binds to the antigen. In one embodiment, the inhibitory agent is a soluble cognate of the antigen binding domain. In another embodiment, the inhibitory agent is a soluble binding domain having a specificity to the same antigen. In still another embodiment, the inhibitory agent comprises an antibody, a Fv, a Fab, a (Fab')2, a heavy chain variable region of an antibody (vH domain), a light chain variable region of an antibody (vL domain), a single domain antibody, a single chain variable fragment (scFv), a monomeric variable region of an antibody, a camelid vHH domain, a non-immunoglobulin antigen binding domain (e.g., DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein), a ligand or a fragment thereof having specificity to the same antigen. In yet another embodiment, the cell is incubated with the inhibitory agent prior to and/or concurrent with contacting the cell with a retroviral vector comprising a nucleic acid encoding an antigen binding receptor (ABR). In a further embodiment, the ABR comprises an antigen binding domain that binds to the antigen. In a further embodiment, the cell is a disease causing or disease associated cell.

The disclosure also provides a producer cell line comprising (i) a recombinant polynucleotide encoding a reporter operably linked to a transmembrane or a membrane-anchoring domain; and (ii) a polynucleotide encoding at least a retroviral GAG and POL polypeptide; and (iii) a polynucleotide encoding at least an envelop protein; and iv) a polynucleotide encoding at least one antigen binding receptor. In one embodiment, the reporter is a luciferase. In yet another embodiment, the reporter is expressed on the surface of the producer cell line. In a further embodiment, the luciferase is expressed on the surface of the producer cell line. In still another embodiment, the producer cell line produces recombinant retroviral vectors comprising the reporter and containing a polynucleotide encoding the antigen binding receptor. In another embodiment of any of the foregoing embodiments, the antigen binding receptor is a chimeric antigen receptor. In another embodiment, the reporter is thermostable with serum half-life at 37° C. that is more than 2 hours, 4 hours, 6 hours, 8 hours, 10 hours, 12 hours, 24 hours, 36 hours, 48 hours or 72 hours. In yet another embodiment, the reporter is any one or more of the following but not limited to GLuc, NLuc, MLuc7, HTLuc, PaLuc1, PaLuc2, MpLuc1, McLuc1, MaLuc1, MoLuc1, MoLuc2, MLuc39, PsLuc1, LoLuc1-3, HtLuc2, TurboLuc16 (TLuc), *Renilla* Luc, Firefly luciferase (FfLuc or Fluc), LucPPe-146-1H2, LucPPe-133-1B2, LucPPe-78-0B10, LucPPe49-7C6A, LucPpL-81-6G1 or CBGRluc or homologs or orthologs or mutants or derivatives thereof. In another embodiment, the reporter is expressed in the cytosol of the packaging or producer cells. In still another embodiment, the reporter is expressed on the cell membranes of the packaging cells that are used to produce the viral vector. In another embodiment, the reporter comprises a membrane anchoring domain (e.g., a GPI linker). In yet another embodiment, the reporter comprises a secretory signal. In yet another embodiment, the reporter is expressed in the packaging cells stably. In still another embodiment, the reporter is expressed in the packaging cells transiently. In another embodiment, the reporter is expressed using a vector that has promoter, enhancers and regulatory elements that are functional in the packaging cells. In yet another embodiment, the polynucleotide comprises a lentiviral vector or a γ retroviral vector. In another embodiment, the reporter is expressed in the packaging cells along with the genes encoding for an envelope protein and gag, pol and rev proteins. In yet another embodiment, the reporter is expressed using an expression vector that also expresses the envelop protein. IN a further embodiment, the envelop protein is VSVG protein, Gibbon-ape leukaemia virus (GALV) envelope, the Amphotropic envolope or Measles envelope or baboon retroviral envelope glycoprotein. In another embodiment, the reporter activity is measured following the addition of a suitable substrate. In still another embodiment, the reporter activity is measured by addition of a substrate chosen from D-luciferin, coelentrazine, imidazopyrazinone substrate (furimazine) or a derivative thereof. In another embodiment, the reporter activity is measured using a luminometer. In another embodiment, the reporter activity is measured by measurement of absorbance or fluorescence.

The disclosure also provides a method of determining a titer of retroviral vector containing a polynucleotide encoding an antigen binding receptor comprising culturing the producer cell of as described above under conditions to produce a retroviral vector; isolating the retroviral vector to obtain a retroviral preparation; and measuring the amount of reporter in the retroviral preparation compared to a control thereby determining the amount of retroviral vector.

The disclosure also provides a method of improving the safety and efficacy of a cell-based receptor therapy comprising administering immune modulating agent (IMA) having a half-life of less than a half-life of the cell-based receptor therapy, which IMA interferes with the interaction between an immune effector cell and the target antigen. In one embodiment, the cell-based receptor therapy comprises (a) cells expressing a chimeric antigen receptor having at least one antigen binding domain; or (b) T/NK cell activating bispecific/multispecific antibody having at least one antigen binding domain; or (c) both (a) and (b). In another embodiment, the IMA is selected from the group consisting of (i) a single chain variable fragment (scFv) of an antibody; (ii) a vL domain; (iii) a vH domain; (iv) a vHH domain; (v) a single domain antibody; (vi) an antibody fragment; (vii) an antibody; (viii) an antibody like moiety; (ix) a non-immunoglobulin antigen binding module; (x) a soluble receptor; and (xi) a ligand. In another embodiment, the IMA has amino acid sequence which has at least 80% sequence homology to an antigen binding domain. In still another embodiment, the IMA binds to the same and/or competing epitope of an antigen as bound by the antigen binding domain. In yet another embodiment, the IMA has amino acid sequence which has at least 80% sequence homology to a CD3 binding domain. In yet another embodiment, the IMA has amino acid sequence which has at least 80% sequence homology to CDRs (complement determining regions) of the vL and/or vH fragments of a CD3 antigen binding domain of a T-cell activating bispecific/multispecific antibody. In yet another embodiment, the IMA has serum half-life less than 12 hours. In another embodiment, the IMA has serum half-life that is shorter than the serum half-life of the T cell activating bispecific/multispecific antibody. In still another embodiment, the IMA is administered by continuous intravenous or subcutaneous infusion. In yet another embodiment, the IMA is administered to prevent, ameliorate or treat the side effect of cell therapy or immune cell activating bispecific/multispecific antibody therapy. In another embodiment, the IMA binds to one or more antigens selected from the group consisting of: CD3, NKp46, CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8) aNeu5Ac(2-3)bDGa1p(1-4)bDG1cp(1-1)Cer); TNF receptor family member B cell maturation (BCMA); Tn antigen ((Tn Ag) or (Ga1NAcα-Ser/Thr)); prostate-specific membrane antigen (PSMA); Receptor tyrosine kinase-like orphan receptor 1 (ROR1); FmsLike Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDCla1p(1-4) bDG1cp(1-1)Cer); transglutaminase 5 (TGS5); high molecular weight-melanomaassociated antigen (HMW-MAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ES0-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPlB 1); CCCTC-Binding Factor (Zinc Finger Protein)-Like (BORIS or Brother of the Regulator of imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCRgamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, and low conductance chloride channel and Integrin B7.

The disclosure also provides a method of improving the safety and efficacy of a cell-based receptor therapy comprising administering a C5 inhibitor to a subject in need thereof. In one embodiment, the C5 inhibitor is administered to a subject for the prevention or treatment of CRS and/or CRES.

DETAILED DESCRIPTION

Figure 1A:
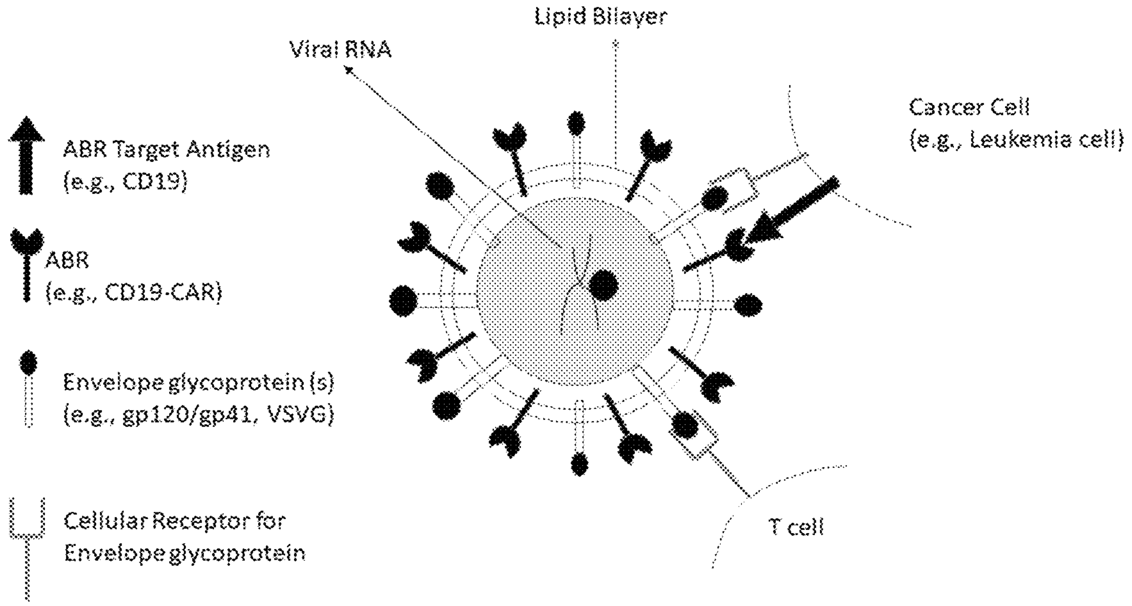
FIG. 1A-B. A schematic representation of the mechanism via which a lentiviral particle expressing an antigen binding receptor (ABR) preferentially infects a cancer cell expressing its target antigen as compared to a T cell (FIG. 1A). A schematic representation of the exemplary agents that can be used to reduce the accidental insertion of a lentiviral particle expressing an antigen binding receptor (ABR) into a cancer cell (e.g., Leukemia cell). The exemplary agents include (1) an agent (e.g., scFv, vHH etc.) with an antigen binding domain that is different than the antigen binding domain of the ABR and which binds an epitope distinct from but overlapping with the epitope targeted by the antigen binding domain of the ABR; (2) an agent (e.g., scFv, vHH etc.) with an antigen binding domain that is identical to the antigen binding domain of the ABR; (3) an antibody or fragment thereof with an antigen binding domain that binds an epitope distinct from but overlapping with the epitope targeted by the antigen binding domain of the ABR; (4) an antibody or fragment thereof with an antigen binding domain that binds an epitope identical to the epitope targeted by the antigen binding domain of the ABR; (5) a soluble form of the antigen targeted by the ABR; (6) a non-immunoglobulin agent that binds to the antigen binding domain of ABR and reduces its binding to its target antigen; (7) an anti-idiotype antibody or a fragment thereof that binds to the antigen binding domain of the ABR and prevents its binding to its target antigen.

As used herein and in the appended claims, the singular forms "a," "an," and "the" include plural referents unless the context clearly dictates otherwise. Thus, for example, reference to "a cell" includes a plurality of such cells and reference to "the polynucleotide" includes reference to one or more polynucleotides and so forth.

Also, the use of "or" means "and/or" unless stated otherwise. Similarly, "comprise," "comprises," "comprising" "include," "includes," and "including" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of."

Unless otherwise defined, all technical and scientific terms used herein have the same meaning as commonly understood by one of ordinary skill in the art to which this invention belongs. Allen et al., *Remington: The Science and Practice of Pharmacy* 22$^{nd}$ *ed.*, Pharmaceutical Press (Sep. 15, 2012); Hornyak et al., *Introduction to Nanoscience and Nanotechnology*, CRC Press (2008); Singleton and Sainsbury, *Dictionary of Microbiology and Molecular Biology* 3$^{rd}$ *ed.*, revised ed., J. Wiley & Sons (New York, NY 2006); Smith, *March's Advanced Organic Chemistry Reactions, Mechanisms and Structure* 7$^{th}$ *ed.*, J. Wiley & Sons (New York, NY 2013); Singleton, *Dictionary of DNA and Genome Technology* 3$^{rd}$ *ed.*, Wiley-Blackwell (Nov. 28, 2012); and Green and Sambrook, *Molecular Cloning: A Laboratory Manual* 4th *ed.*, Cold Spring Harbor Laboratory Press (Cold Spring Harbor, NY 2012), provide one skilled in the art with a general guide to many of the terms used in the present application. For references on how to prepare antibodies, see Greenfield, *Antibodies A Laboratory Manual* 2$^{nd}$ *ed.*, Cold Spring Harbor Press (Cold Spring Harbor NY, 2013); Köhler and Milstein, *Derivation of specific antibody-producing tissue culture and tumor lines by cell fusion*, Eur. J. Immunol. 1976 July, 6(7):511-9; Queen and Selick, *Humanized immunoglobulins*, U.S. Pat. No. 5,585,089 (1996 December); and Riechmann et al., *Reshaping human antibodies for therapy*, Nature 1988 Mar. 24, 332(6162):323-7A11 headings and subheading provided herein are solely for ease of reading and should not be construed to limit the invention. Although methods and materials similar or equivalent to those described herein can be used in the practice or testing of the invention, suitable methods and materials are described below. All publications, patent applications, patents, and other references mentioned herein are incorporated by reference in their entirety. In case of conflict, the present specification, including definitions, will control. In addition, the materials, methods, and specific examples are illustrative only and not intended to be limiting.

All publications herein are incorporated by reference to the same extent as if each individual publication or patent application was specifically and individually indicated to be incorporated by reference. Any references cited are not an admission that any of the information provided therein is prior art or relevant to the presently claimed invention, or that any publication specifically or implicitly referenced is prior art.

Initial first-generation CARs were constructed through the fusion of a scFv (single chain fragment variable)-based antigen binding domain to an inert CD8 transmembrane domain, linked to a cytoplasmic signaling domain derived from the CD3-ζ or Fc receptor γ chains.

Although CD3-ζ chain aggregation is sufficient to enable lytic activity of T-cells, they failed to elicit a robust cytokine response, including interleukin-2 (IL-2), and support T-cell expansion upon repeated exposure to antigen. For optimal activation and proliferation, T cells require both T-cell receptor engagement and signaling, as well as costimulatory signaling through costimulatory receptors (i.e., CD28, 4-1BB, OX-40) on T cells binding to cognate ligands (i.e., CD80/86, 4-1BBL, OX-40L) expressed either by the targeted tumor cell or the antigen-presenting cells. To overcome the lack of T-cell co-stimulation, first generation CARs were further modified by incorporating the cytoplasmic signaling domains of T-cell costimulatory receptors. These second-generation CARs enhanced signaling strength and persistence of the modified T cells, leading to superior antitumor activity. Signaling through the costimulatory domains present in the 2nd generation CAR constructs results in activation of several signaling pathways, such as NF-κB and ERK. In particular, AKT activation promotes T cell activation but has been also shown to results in terminal differentiation, exhaustion and lack of persistence.

The CAR constructs in current clinical use are artificial in design as they represent fusion of several different proteins. In particular, inclusion of co-stimulatory domain in the 2$^{nd}$ generation CAR construct results in non-physiological signaling through the receptor, which in turn could contribute to their toxicity. Some CARs show tonic antigen-independent signaling, which leads to unrestrained cellular activation, eventually resulting in apoptosis, excessive cytokine release independent of cognate antigens, and immunologic exhaustion. Tonic signaling through co-stimulatory domains (e.g., 41BB and CD28 domain) has been shown to impede T cell survival. Thus, there is a need for improving the CAR design to achieve long term persistence of CAR modified T cells without the risk of excessive toxicity, such as cytokine release syndrome (CRS).

To overcome some of the design limitation of conventional 2nd generation CARs, several alternative designs, collectively termed next generation CARs, have been described, including Ab-TCR (WO 2017/070608 A1 incorporated herein by reference), TCR receptor fusion proteins or TFP (WO 2016/187349 A1 incorporated herein by reference), Synthetic Immune Receptors (SIRs) (see, WO 2018/102795 A1, incorporated herein by reference), Tri-functional T cell antigen coupler (Tri-TAC) (see, WO 2015/117229 A1, incorporated herein by reference). These alternative CAR designs, in general, lack a co-stimulatory domain.

Despite the remarkable clinical outcome of CAR-T in B-ALL and lymphoma, the high rate of complete responses is partially offset by a substantial number of relapses, often with undetectable CD19 on the leukemic cells, involving several different mechanisms. Furthermore, a recent study reported a patient relapsing 9 months after CD19-targeted CAR T cell (CTL019) infusion with CD19-leukemia that aberrantly expressed the anti-CD19 CAR (Ruella, M et al, Nature Medicine, 2018). The CAR gene was unintentionally introduced into a single leukemic B cell during T cell manufacturing, and its product bound in cis to the CD19 epitope on the surface of leukemic cells, masking it from recognition by and conferring resistance to CD19 CAR-T cells. The patient in this study eventually died from relapse of his leukemia which had become resistant to CD19-CAR-T cells. This report highlights the clinical need and importance of preventing the accidental insertion of CAR construct into the cancer cells, e.g., leukemia cells, during the process of CAR-T cell manufacturing. The problem is not limited to CARs but can arise during viral mediated gene delivery of any recombinant receptor. In particular, the problem can arise during viral mediated gene delivery of any recombinant receptor that has an antigen binding domain, i.e. a domain that can bind to an antigen, and is expressed on cell surface. The antigen binding domain of the antigen binding receptor (ABR) can comprise of an antibody, an antibody like moiety, an antibody fragment, a cytokine, a ligand or a receptor. Accordingly, this disclosure provides methods to prevent the accidental insertion of CAR into a cancer cell; these methods are also applicable to prevent the accidental insertion of any antigen binding receptor than contains an antigen binding domain. Exemplary such receptors can be antigen masking receptor (AMR) described herein. In addition, the methods of the disclosure can prevent the accidental insertion of next generation CARs (e.g., TFP, Tri-TAC etc.) into cancer cells.

The disclosure offers a solution to the problem of accidental insertion of antigen binding receptors (ABRs) (e.g., a CAR, TFP, TAC etc.) into cancer cells. The disclosure is based on the discovery that ABR (e.g., a CAR, TFP, TAC etc.) polypeptides get inserted into the envelope of lentiviral vectors when the lentivirus is being produced in the producer cell line (e.g., 293FT cells). For example, a CD19-CAR polypeptide can be expressed by the producer cell line and translocated to the cellular membrane, where upon budding of the lentiviral vectors the CD19-CAR gets inserted into the envelope of a lentivirus containing the CD19 CAR polynucleotide. The resulting lentivirus can then enter the target cells through two mechanisms: (1) via the fusion of the envelop protein (e.g., VSVG envelop glycoprotein in case of VSVG pseudotyped virus) to its receptor and (2) via attachment of the antigen binding receptor (ABR) polypeptide to its target antigen (e.g., CD19 in case of a CD19 targeted CAR polypeptide). In the case of T cells, only the first mechanism is operative. However, in case of a cancer cell, e.g., a leukemia cell or lymphoma cell; e.g., a CD19-expressing leuekemia or lymphoma cell, both the mechanisms are at play, resulting in preferential insertion of CAR construct into cancer cells (e.g., leukemia cells or lymphoma cells). The disclosure provides methods and compositions to inhibit the accidental insertion of a ABR (e.g., a CAR, TFP, TAC etc.) into a cell, e.g., a cancer cell, by including an agent, such as an antibody, an antibody fragment, a vHH domain, a non-immunoglobulin antigen binding domain, a soluble receptor, or Protein L or a fragment thereof, that blocks the interaction of the antigen binding domain of the recombinant antigen binding receptor polypeptide (e.g., CAR polypeptide, e.g., CD19 scFV fragment comprising the CD19 CAR) with the antigen (e.g., CD19) being targeted by the ABR (e.g., a CAR, TFP, TAC etc.). In one embodiment, the accidental insertion of a ABR (e.g., a CAR, TFP, TAC etc.) into any cell (e.g., a cancer cell) can be reduced by including an antigen binding agent that binds to the target antigen of the ABR (e.g., a CAR, TFP, TAC etc.) expressed on that cell (e.g., cancer cell). In one embodiment, the antigen binding agent is selected from the group of but not limited to a (1) an antibody; (2) an antibody fragment (e.g. a Fv, a Fab, a (Fab')2); (3) a heavy chain variable region of an antibody (vH domain) or a fragment thereof; (4) a light chain variable region of an antibody (vL domain) or a fragment thereof; (5) a single chain variable fragment (scFv) or a fragment thereof; (6) a single domain antibody (SDAB) or a fragment thereof; (7) a camelid VHH domain or a fragment thereof; (8) a monomeric variable region of an antibody; (9) a non-immunoglobulin antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) any other antigen-binding agent that can block the interaction of the ABR (e.g., a CAR, TFP etc.) with the target antigen.

The disclosure provides a method comprising contacting an ex vivo cell population with a first binding domain that binds to a first cell surface antigen on the ex vivo cell population; contacting the ex vivo cell population with a recombinant viral vector comprising a polynucleotide encoding an ABR (e.g., a CAR, TFP etc.) targeting the first cell surface antigen; and culturing the ex vivo cell population under condition such that the viral vector transforms the ex vivo cell population. The first binding domain can comprise any of a plurality of different molecules including, but not limited to, (1) an antibody; (2) an antibody fragment (e.g. a Fv, a Fab, a (Fab')2); (3) a heavy chain variable region of an antibody (vH domain) or a fragment thereof; (4) a light chain variable region of an antibody (vL domain) or a fragment thereof; (5) a single chain variable fragment (scFv) or a fragment thereof; (6) a single domain antibody (SDAB) or a fragment thereof; (7) a camelid VHH domain or a fragment thereof; (8) a monomeric variable region of an antibody; (9) a non-immunoglobulin antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) any other antigen-binding agent that can bind to the first cell surface antigen.

The disclosure also provides a method comprising contacting an ex vivo cell population with a soluble antigen or fragment thereof that binds to an antigen binding domain on a retroviral vector comprising a polynucleotide encoding an ABR (e.g., a CAR, TFP etc.) targeting a first cell surface antigen with ex vivo cell population, wherein the soluble antigen or fragment thereof also binds to the ABR targeting the first cell surface antigen; contacting the ex vivo cell population with a recombinant viral vector comprising a polynucleotide encoding an ABR (e.g., a CAR, TFP etc.) targeting the first cell surface antigen; and culturing the ex vivo cell population under condition such that the viral vector transforms the ex vivo cell population. The soluble antigen or fragment thereof is a cognate to the binding domain of the ABR (e.g., a CAR, TFP etc.) and inhibits the interaction of an ABR (e.g., a CAR, TFP etc.) present on the envelope of the viral vector with its binding partner on cells in the ex vivo population of cells.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods or describe the compositions herein. Moreover, any value or range (e.g., less than 20 or similar terminology) explicitly includes any integer between such values or up to the value. Thus, for example, "one to five mutations" explicitly includes 1, 2, 3, 4, and/or 5 mutations.

The term "ABR" or "Antigen Binding Receptor" as described herein refers to any receptor that has an antigen binding domain. The antigen binding domain of an ABR may comprise of a scFv, a vL, vH, VHH, antibody, antibody fragment (e.g., Fab), antibody like moiety, Vα, Vβ, cytokine, receptor etc. In one embodiment, an ABR has a transmembrane or membrane anchoring domain that allows it to be expressed on the cell surface. Exemplary ABR include a 1$^{st}$ generation CAR, a 2$^{nd}$ generation CAR, a TFP, a TRI-TAC or TAC etc. Antigen masking receptors, as described herein, are also examples of ABR.

The term "Ab-TCR" or "AbTCR" refers to a next generation CAR platform as described in WO 2017/070608 A1 which is incorporated herein by reference. In an embodiment, an Ab-TCR comprises an antibody moiety that specifically binds to a target antigen fused to a TCR module capable of recruiting at least one TCR signaling module. Exemplary TCR modules that can be used in the construction of Ab-TCR are provided in SEQ ID NO:6009-6014 (Table 6) and in WO 2017/070608 A1 which is incorporated herein by reference.

The term "accessory module" refers to any one or more of PDL1, PDL2, CD80, CD86, crmA, p35, hNEMO-K277A (or NEMO-K277A), hNEMO-K277A-delta-V249-K555, mNEMO-K270A, K13-opt, IKK2-S177E-S181E (or IKK2-SS/EE), IKK1-S176E-S180E (or IKK1-SS/EE), MyD88-L265P, TCL-1a, MTCP-1, CMV-141, 41BBL, CD40L, vFLIP-K13, MC159, cFLIP-L/MRITα, cFLIP-p22, HTLV1 Tax, HTLV2 Tax, HTLV2 Tax-RS mutant, FKBPx2-K13, FKBPx2-HTLV2-Tax, FKBPx2-HTLV2-Tax-RS, IL6R-304-vHH-Alb8-vHH, IL12f, PD1-4H1 scFV, PD1-5C4 scFV, PD1-4H1-Alb8-vHH, PD1-5C4-Alb8-vHH, CTLA4-Ipilimumab-scFv, CTLA4-Ipilimumab-Alb8-vHH, IL6-19A-scFV, IL6-19A-scFV-Alb8-vHH, sHVEM, sHVEM-Alb8-vHH, hTERT, Fx06, shRNA targeting Brd4, IgSP-[hTRAC-opt2], IgSP-[hTRBC-opt2] and combination thereof that is expressed in an immune cell (e.g., T cell, e.g., CAR-T cell or TCR-T cell) to decrease, regulate or modify the activity of the immune cell. In some embodiments, the accessory module is co-expressed with an immune receptor such as a CAR or a TCR to increase, decrease, regulate or modify the expression or activity of a CAR or a TCR or a CAR-expressing or a TCR-expressing cell. The accessory module can be co-expressed with a CAR or a TCR using a single vector or using two or more different vectors. In a further embodiment, the accessory module comprises an FKBP (FK506 binding protein)-fusion protein, such as FKBPx2-NEMO, whose activity can be controlled by the administration of a dimerizer molecule. In some embodiments, the accessory module is expressed in an antigen presenting cell, e.g., a dendritic cell.

As used herein "affinity" is meant to describe a measure of binding strength. Affinity, in some instances, depends on the closeness of stereochemical fit between a binding agent and its target (e.g., between an antibody and antigen including epitopes specific for the binding domain), on the size of the area of contact between them, and on the distribution of charged and hydrophobic groups. Affinity generally refers to the "ability" of the binding agent to bind its target. There are numerous ways used in the art to measure "affinity". For example, methods for calculating the affinity of an antibody for an antigen are known in the art, including use of binding experiments to calculate affinity. Binding affinity may be determined using various techniques known in the art, for example, surface plasmon resonance, bio-layer interferometry, dual polarization interferometry, static light scattering, dynamic light scattering, isothermal titration calorimetry, ELISA, analytical ultracentrifugation, and flow cytometry. An exemplary method for determining binding affinity employs surface plasmon resonance. Surface plasmon resonance is an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). As used herein, the term "specific binding" means the contact between an antibody and an antigen with a binding affinity of at least $10^{-6}$ M. In certain aspects, antibodies bind with affinities of at least about $10^{-7}$ M, and typically $10^{-8}$ M, $10^{-9}$ M, $10^{-10}$ M, $10^{-11}$M, or $10^{-12}$ M.

The term "antibody," as used herein, refers to a protein, or polypeptide sequence derived from an immunoglobulin molecule which specifically binds with an antigen. Antibodies can be monoclonal, or polyclonal, multiple or single chain, or intact immunoglobulins, and may be derived from natural sources or from recombinant sources. Antibodies can be tetramers of immunoglobulin molecules. The antibody may be 'humanized', 'chimeric' or non-human.

The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab'h, Fv fragments, scFv antibody fragments, disulfide-linked Fvs (sdFv), a Fd fragment consisting of the VH and CH1 domains, linear antibodies, single domain antibodies (sdAb) such as either vL or vH, camelid vHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3) (see U.S. Pat. No. 6,703,199, which describes fibronectin polypeptide minibodies).

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

"Anticancer agent" refers to agents that inhibit aberrant cellular division and growth, inhibit migration of neoplastic cells, inhibit invasiveness or prevent cancer growth and metastasis. The term includes chemotherapeutic agents, biological agent (e.g., siRNA, viral vectors such as engineered MLV, adenoviruses, herpes virus that deliver cytotoxic genes), antibodies and the like.

The term "anticancer effect" refers to a biological effect which can be manifested by various means, including but not limited to, a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anticancer effect" can also be manifested by the ability of the CARs in prevention of the occurrence of cancer in the first place.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. The disclosure includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

Non-limiting examples of target antigens include: CD5; CD19; CD123; CD22; CD30; CD171; CS1 (also referred to as CD2 subset 1, CRACC, MPL, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac (2-8)aNeu5Ac(2-3)bDGa1p(1-4)bDG1cp(1-1)Cer); TNF receptor family member B cell maturation (BCMA); Tn antigen ((Tn Ag) or (Ga1NAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3)bDClalp(l-4)bDGlcp(1-1) Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPlB 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGL11, TCRgamma-delta, NKG2D, CD32 (FCGR2A), Tn ag, Tim1-/HVCR1, CSF2RA (GM-CSFR-alpha), TGFbetaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRC5D, Claudin18.2 (CLD18A2 or CLDN18A.2), P-glycoprotein, STEAP1, Liv1, Nectin-4, Cripto, gpA33, BST1/CD157, low conductance chloride channel, and the antigen recognized by TNT antibody.

The term "antigen masking receptor (AMR)" as used herein refers to a receptor that is capable of binding to an endogenous protein and/or interfering with one or more functions of the said protein. In an embodiment, an antigen masking receptor comprises an antigen-binding domain that binds to an endogenous protein, an optional hinge domain and an optional membrane anchoring domain. In an embodiment, a chimeric antigen receptor (e.g., a first or a second generation CAR) can act as an AMR. In an embodiment, an antigen masking receptor comprises an antigen-binding domain that binds to an endogenous protein, an optional hinge domain and an optional glycosylphosphatidylinositol-linked protein (GPI) linker domain. In an alternate embodiment, an antigen masking receptor comprises an antigen-binding domain that binds to an endogenous protein and an optional anchoring domain that anchors it to a cellular compartment (e.g., golgi or endoplasmic reticulum).

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

The term "anti-infection effect" refers to a biological effect that can be manifested by various means, including but not limited to, e.g., decrease in the titer of the infectious agent, a decrease in colony counts of the infectious agent, amelioration of various physiological symptoms associated with the infectious condition. An "anti-infectious effect" can also be manifested by the ability of the peptides, polynucleotides, cells and antibodies in prevention of the occurrence of infection in the first place.

The term "antitumor effect" or "anti-cancer effect" refers to a biological effect which can be manifested by various means, including but not limited to, e.g., a decrease in tumor volume, a decrease in the number of tumor cells, a decrease in tumor cell proliferation, inhibition of metastasis, or a decrease in tumor cell survival.

An "antigen binding domain" or "antigen binding module" or "antigen binding segment" or "antigen specific domain" (ASD) refers to a polypeptide or peptide that due to its primary, secondary or tertiary sequence, post-translational modifications and/or charge binds to an antigen with a high degree of specificity. The antigen binding domain may be derived from different sources, for example, an antibody (full length heavy chain, Fab fragments, single chain Fv (scFv) fragments, divalent single chain antibodies or diabodies), a non-immunoglobulin binding protein, a ligand or a receptor. There are, however, numerous alternatives, such as linked cytokines (which leads to recognition of cells bearing the cytokine receptor), affibodies, ligand binding domains from naturally occurring receptors, soluble protein/peptide ligand for a receptor (for example on a tumor cell), peptides, and vaccines to prompt an immune response, which may each be used in various embodiments of the disclosure. In some embodiments, almost any molecule that binds a given cognate or antigen with high affinity can be used as an ASD, as will be appreciated by those of skill in the art. In some embodiments, the antigen binding domain comprises T cell receptors (TCRs) or portions thereof. In exemplary embodiments, the target antigens and SEQ ID Nos of antigen binding domains comprising scFvs are set forth herein in SEQ ID Nos (DNA): 205-453 and SEQ ID Nos (PRT): 6091-6339 of Table 7. In exemplary embodiments, the target antigen and SEQ ID NOs of vL, vH, scFVs, and their CDR regions are set forth herein in Tables 6A-C of patent application PCT/US18/53247, which is incorporated in its entirety by reference herein.

The term "Association constant (Ka)" is defined as the equilibrium constant of the association of a receptor and ligand.

"Autoantibody" refers to an antibody that is produced by a B-cell specific for an autoantigen.

The term "autoantigen" refers to an endogenous antigen that stimulates production of an autoimmune response, such as production of autoantibodies. Autoantigen also includes a self-antigen or antigen from a normal tissue that is the target of a cell mediated or an antibody-mediated immune response that may result in the development of an autoimmune disease. Examples of autoantigens include, but are not limited to, desmoglein 1, desmoglein 3, and fragments thereof.

"Avidity" refers to the strength of the interaction between a binding agent and its target (e.g., the strength of the interaction between an antibody and its antigen target, a receptor and its cognate and the like). The avidity can be weak or strong. Methods for calculating the affinity of an antibody for an antigen are known in the art, including use of binding experiments to calculate affinity. Antibody activity in functional assays (e.g., flow cytometry assay or Malibu-Glo assay) is also reflective of antibody affinity.

As used herein, the term "backbone" refers to the specific combination of CARs (Table 1) and accessory modules as described in Table 2. In exemplary embodiments, specific combinations of CARs and accessory modules which comprise various backbones are described in Table 2. In one embodiment, the CAR and the accessory module are encoded by a single nucleic acid molecule. In another embodiment, the CAR is encoded by the first nucleic acid molecule and the accessory module is encoded by a second nucleic acid molecule. In some embodiments, the accessory module is encoded by more than one nucleic acid molecule, depending on the number of components in the accessory modules.

Table 1: Conventional CAR architectures. First generation conventional CARs (Conventional CAR I) have an intracellular signaling (ISD) domain (e.g. CD3z) and no costimulatory domain. The TCR fusion proteins (TFP) are another example of conventional CAR 1. Second generation conventional CARs (Conventional CAR 2 or CAR II) have one costimulatory domain (e.g. 41BB or CD28) and an intracellular signaling (ISD) domain (e.g. CD3z). Third generation conventional CARs (Conventional CAR 3 or CAR III) have two costimulatory domains (e.g. 41BB and CD28) and an intracellular signaling (ISD) domain (e.g. CD3z). Ab-TCRs are duel chain receptors and have been described in PCT/US2016/058305. cTCRs are single chain, one-and-half, or double chain receptors consisting of antigen binding domain derived from a vL and vH fragment that are fused to one or more TCR constant chain and result in activation of T cell signaling. Different configurations of cTCR are described in WO 2018/102795 A1. Synthetic immune receptors are next generation CARs and are described in WO 2018/102795 A1:

TABLE 1

Conventional CAR Architectures

| | | | | | | | | |
|---|---|---|---|---|---|---|---|---|
| 1 | CAR 1 or CAR I (including TFP) | ASD | HR | TMD | ISD | | | |
| 2 | CAR 2 (CAR II) | ASD | HR | TMD | CSD | ISD | | |
| 3 | CAR 3 (CAR III) | ASD | HR | TMD | CSD-I | CSD-II | ISD | |
| 4 | Ab-TCR | vL-cL | TCRD(1) | 2A | vH-CH1 | TCRD(II) | | |
| 5 | Double Chain cTCR/SIR-1 | vL | TCR-C(1) | 2A | vH | TCR-C(II) | | |
| 6 | One & Half Chain cTCR/SIR-3 | | TCR-C(1) | 2A | ASD | TCR-C(II) | | |

TABLE 2

Exemplary Backbones

| Backbone No. | CAR Component | Accessory Module NAME | SEQ ID (DNA) | SEQ ID (PRT) |
|---|---|---|---|---|
| Backbone 1 | CAR I | PDL1 | 72 | 5958 |
| Backbone 2 | CAR I | PDL2 | 73 | 5959 |
| Backbone 3 | CAR I | K13 | 75 | 5961 |
| Backbone 4 | CAR I | MC159 | 76 | 5962 |
| Backbone 5 | CAR I | crmA | 77 | 5963 |
| Backbone 6 | CAR I | p35 | 78 | 5964 |
| Backbone 7 | CAR I | CD80 | 71 | 5957 |
| Backbone 8 | CAR I | CD86 | 79 | 5965 |
| Backbone 9 | CAR II | PDL1 | 72 | 5958 |
| Backbone 10 | CAR II | PDL2 | 73 | 5959 |
| Backbone 11 | CAR II | K13 | 75 | 5961 |
| Backbone 12 | CAR II | MC159 | 76 | 5962 |
| Backbone 13 | CAR II | crmA | 77 | 5963 |
| Backbone 14 | CAR II | p35 | 78 | 5964 |
| Backbone 15 | CAR II | CD80 | 71 | 5957 |
| Backbone 16 | CAR II | CD86 | 79 | 5965 |
| Backbone 17 | CAR III | PDL1 | 72 | 5958 |
| Backbone 18 | CAR III | PDL2 | 73 | 5959 |
| Backbone 19 | CAR III | K13 | 75 | 5961 |
| Backbone 20 | CAR III | MC159 | 76 | 5962 |
| Backbone 21 | CAR III | crmA | 77 | 5963 |
| Backbone 22 | CAR III | p35 | 78 | 5964 |
| Backbone 23 | CAR III | CD80 | 71 | 5957 |

TABLE 2-continued

Exemplary Backbones

| Backbone No. | CAR Component | Accessory Module NAME | Accessory Module SEQ ID (DNA) | Accessory Module SEQ ID (PRT) |
|---|---|---|---|---|
| Backbone 24 | CAR III | CD86 | 79 | 5965 |
| Backbone 25 | Ab-TCR | PDL1 | 72 | 5958 |
| Backbone 26 | Ab-TCR | PDL2 | 73 | 5959 |
| Backbone 27 | Ab-TCR | K13 | 75 | 5961 |
| Backbone 28 | Ab-TCR | MC159 | 76 | 5962 |
| Backbone 29 | Ab-TCR | crmA | 77 | 5963 |
| Backbone 30 | Ab-TCR | p35 | 78 | 5964 |
| Backbone 31 | Ab-TCR | CD80 | 71 | 5957 |
| Backbone 32 | Ab-TCR | CD86 | 79 | 5965 |
| Backbone 33 | DC-cTCR/SIR | PDL1 | 72 | 5958 |
| Backbone 34 | DC-cTCR/SIR | PDL2 | 73 | 5959 |
| Backbone 35 | DC-cTCR/SIR | K13 | 75 | 5961 |
| Backbone 36 | DC-cTCR/SIR | MC159 | 76 | 5962 |
| Backbone 37 | DC-cTCR/SIR | crmA | 77 | 5963 |
| Backbone 38 | DC-cTCR/SIR | p35 | 78 | 5964 |
| Backbone 39 | DC-cTCR/SIR | CD80 | 71 | 5957 |
| Backbone 40 | DC-cTCR/SIR | CD86 | 79 | 5965 |
| Backbone 41 | OHC-cTCR/SIR | PDL1 | 72 | 5958 |
| Backbone 42 | OHC-cTCR/SIR | PDL2 | 73 | 5959 |
| Backbone 43 | OHC-cTCR/SIR | K13 | 75 | 5961 |
| Backbone 44 | OHC-cTCR/SIR | MC159 | 76 | 5962 |
| Backbone 45 | OHC-cTCR/SIR | crmA | 77 | 5963 |
| Backbone 46 | OHC-cTCR/SIR | p35 | 78 | 5964 |
| Backbone 47 | OHC-cTCR/SIR | CD80 | 71 | 5957 |
| Backbone 48 | OHC-cTCR/SIR | CD86 | 79 | 5965 |

As used herein “beneficial results” may include, but are not limited to, lessening or alleviating the severity of the disease condition, preventing the disease condition from worsening, curing the disease condition, preventing the disease condition from developing, lowering the chances of a patient developing the disease condition and prolonging a patient’s life or life expectancy. As non-limiting examples, “beneficial results” or “desired results” may be alleviation of one or more symptom(s), diminishment of extent of the deficit, stabilized (i.e., not worsening) state of cancer progression, delay or slowing of metastasis or invasiveness, and amelioration or palliation of symptoms associated with the cancer.

As used herein, the term “binding domain” or “antibody molecule” refers to a protein, e.g., an immunoglobulin chain or fragment thereof, ligand domain or fragment thereof (as the case may be), comprising at least one domain, e.g., immunoglobulin variable domain sequence that can bind to a target with affinity higher than a non-specific domain. The term encompasses antibodies and antibody fragments, or ligands and ligand fragments. In another embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In another embodiment, a multispecific antibody molecule is a bispecific antibody molecule. A bispecific antibody has specificity for two antigens. A bispecific antibody molecule is characterized by a first immunoglobulin variable domain sequence which has binding specificity for a first epitope and a second immunoglobulin variable domain sequence that has binding specificity for a second epitope. A bispecific molecule may be a bispecific T cell engaging antibody in which first antigen binding domain binds to an antigen (e.g., CD3ε) expressed on T cells and the second antigen binding domain binds to an antigen expressed on a disease causing or disease associated cell (e.g., a cancer cell). The bispecific antibodies can be used for inducing T cell mediated cytotoxicity against cells expressing the target antigen recognized by their second antigen binding domain. The antigen binding domains described in this disclosure can be used to construct bispecific T cell engagers. The nucleic acid sequences of exemplary bispecific T cell engagers are presented in SEQ ID NO: 3545-3830 (Table 13) of patent application PCT/US18/53247, which is incorporated in its entirety by reference herein. The corresponding amino acid sequences are presented in SEQ ID NO: 7458-7721 (Table 13) of patent application PCT/US18/53247, which is incorporated in its entirety by reference herein.

“Binds the same epitope as” means the ability of an antibody, scFv, or other antigen binding domain to bind to a target antigen and having the same epitope as an exemplified antibody, scFv, or other antigen binding domain. As an example, the epitopes of the exemplified antibody, scFv, or other binding agent and other antibodies can be determined using standard epitope mapping techniques. Epitope mapping techniques, well known in the art include Epitope Mapping Protocols in Methods in Molecular Biology, Vol. 66 (Glenn E. Morris, Ed., 1996) Humana Press, Totowa, New Jersey. For example, linear epitopes may be determined by, e.g., concurrently synthesizing large numbers of peptides on solid supports, the peptides corresponding to portions of the protein molecule, and reacting the peptides with antibodies while the peptides are still attached to the supports. Such techniques are known in the art and described in, e.g., U.S. Pat. No. 4,708,871; Geysen et al, (1984) Proc. Natl. Acad. Sci. USA 8:3998-4002; Geysen et al, (1985) Proc. Natl. Acad. Sci. USA 82:78-182; Geysen et al, (1986) Mol. Immunol. 23: 709-715. The epitope bound by the antigen binding domain of a CAR can be also determined by the Epitope Binning assay. Epitope binning is a competitive immunoassay used to characterize and then sort a library of monoclonal antibodies against a target protein. Antibodies against a similar target are tested against all other antibodies in the library in a pairwise fashion to see if antibodies block one another’s binding to the epitope of an antigen. After each antibody has a profile created against all of the other antibodies in the library, a competitive blocking profile is created for each antibody relative to the others in the library. Closely related binning profiles indicate that the antibodies have the same or a closely related epitope and are “binned” together. Similarly, conformational epitopes are readily identified by determining spatial conformation of amino acids such as by, e.g., hydrogen/deuterium exchange, x-ray crystallography and two-dimensional nuclear magnetic resonance. See, e.g., Epitope Mapping Protocols, supra. Antigenic regions of proteins can also be identified using standard antigenicity and hydropathy plots, such as those calculated using, e.g., the Omiga version 1.0 software program available from the Oxford Molecular Group. This computer program employs the Hopp/Woods method, Hopp et al, (1981) Proc. Natl. Acad. Sci USA 78:3824-3828; for determining antigenicity profiles, and the Kyte-Doolittle technique, Kyte et al, (1982) J. Mol. Bioi. 157: 105-132; for hydropathy plots. To determine if selected monoclonal antibodies against a target (e.g., CD19) bind to unique epitopes, each antibody can be biotinylated using commercially available reagents (Pierce, Rockford, Ill.). Competition studies using unlabeled monoclonal antibodies and biotinylated monoclonal antibodies can be performed using CD19-extracellualr domain coated-ELISA plates. Biotinylated mAb binding can be detected with a strepavidin-alkaline phosphatase probe. Exemplary epitopes of human CD20 antigen bound by scFv, CARs, AMR, antibodies and other immunotherapeutics of the current disclosure are provided in SEQ ID NO: 15149-15154 of patent application PCT/US18/53247, which is incorporated in its entirety by reference herein. Exemplary epitopes of human BCMA bound by scFv, CARs, AMR, antibodies and other immunotherapeutics of the current disclosure are provided in SEQ ID NO: 15155-15159 of patent application PCT/US18/53247, which is incorporated in its entirety by reference herein. An exemplary epitope of human MPL antigen bound by scFv, CARs, AMR and antibodies of the current disclosure is provided in SEQ ID NO: 15160 of patent application PCT/US18/53247, which is incorporated in its entirety by reference herein.

As used herein, the term "biological equivalent thereof" is intended to be synonymous with "equivalent thereof" when referring to a reference protein, antibody or fragment thereof, polypeptide or nucleic acid, intends those having minimal homology while still maintaining desired structure or functionality. Unless specifically recited herein, it is contemplated that any of the above also includes equivalents thereof. For example, an equivalent intends at least about 70% homology or identity, or at least 80% homology or identity and alternatively, or at least about 85%, or alternatively at least about 90%, or alternatively at least about 95%, or alternatively at least 98% percent homology or identity and exhibits substantially equivalent biological activity to the reference protein, polypeptide, antibody or fragment thereof or nucleic acid. Alternatively, when referring to polynucleotides, an equivalent thereof is a polynucleotide that hybridizes under stringent conditions to the reference polynucleotide or its complement. Alternatively, when referring to polypeptides or proteins, an equivalent thereof is an expressed polypeptide or protein from a polynucleotide that hybridizes under stringent conditions to the polynucleotide or its complement that encodes the reference polypeptide or protein.

CRES or CAR-T related encephalopathy syndrome is a complication seen after administration of immune effector cell therapies, such as CAR-T cells, and involves symptoms such as confusion, aphasia, seizures, headaches, coma and death. CRES, as defined herein, also includes neurological complications seen after other forms of immune effector cellular therapies, including therapies involving administration of cells expressing SIR, TCR, TFP, and Ab-TCR etc. CRES, as defined herein also includes neurological complications seen after hematopoietic stem cell transplant, e.g., blood and/or marrow transplant, e.g., allogeneic stem cell transplant, e.g., haploidentical allogeneic transplant. CRES also describes neurological complications seen after administration of bispecific T cell engaging antibodies, such as Blinatumomab.

As used herein, the term "CDR" or "complementarity determining region" is intended to mean the non-contiguous antigen combining sites found within the variable region of both heavy and light chain polypeptides. These particular regions have been described by Kabat et al., J. Bioi. Chern. 252:6609-6616 (1977); Kabat et al., U.S. Dept. of Health and Human Services, "Sequences of proteins of immunological interest" (1991); Chothia et al., J. Mol. Bioi. 196: 901-917 (1987); and MacCallum et al., J. Mol. Bioi. 25 262:732-745 (1996), where the definitions include overlapping or subsets of amino acid residues when compared against each other. Nevertheless, application of either definition to refer to a CDR of an antibody or grafted antibodies or variants thereof is intended to be within the scope of the term as defined and used herein. As used herein, the different CDRs of an antibody could be also defined by a combination of the different definitions. For example, vHCDR1 could be defined based on Kabat and VHCDR2 could be defined based on Chothia. The amino acid residues which encompass the CDRs as defined by each of the above cited references are as follows:

| CDR DEFINITIONS | | | |
|---|---|---|---|
| | Kabat | Chothia | MacCallum |
| VHCDR1 | 31-35 | 26-32 | 30-35 |
| VHCDR2 | 50-65 | 53-55 | 47-58 |
| VHCDR3 | 95-102 | 96-10 | 193-101 |
| VLCDR1 | 24-34 | 26-32 | 30-36 |
| VLCDR2 | 50-56 | 50-52 | 46-55 |
| VLCDR3 | 89-97 | 91-96 | 89-96 |

(Residue Numbers correspond to the identified reference).

The SEQ IDs of the CDRs of the different vL and vH segments that can make up antigen binding domains of scFv, CARs, AMR, antibodies and other immunotherapeutics of the current disclosure are provided in SEQ ID NO: 13204-14121 and SEQ ID NO: 14122-15039, respectively (Tables 6A, B) of PCT/US18/53247 and in Tables 5-6 in PCT/US2017/064379, which are incorporated herein by reference.

In some embodiments, reference to an antigen-binding module (such as a Fab-like or Fv-like antigen-binding module) that specifically binds to a target antigen means that the antigen-binding module binds to the target antigen with (a) an affinity that is at least about 10 (e.g., about 10, 20, 30, 40, 50, 75, 100, 200, 300, 400, 500, 750, 1000 or more) times its binding affinity for other molecules; or (b) a $K_d$ no more than about 1/10 (e.g., 1/10, 1/20, 1/30, 1/40, 1/50, 1175, 1/100, 1/200, 1/300, 1/400, 1/500, 1/750, 1/1000 or less) times its $K_d$ for binding to other molecules. Binding affinity can be determined by methods known in the art, such as ELISA, fluorescence activated cell sorting (FACS) analysis, Malibu-Glo assay, Topanga Assay, or radioimmunoprecipitation assay (RIA). $K_d$ can be determined by methods known in the art, such as surface plasmon resonance (SPR) assay utilizing, for example, Biacore instruments, or kinetic exclusion assay (KinExA) utilizing, for example, Sapidyne instruments.

"Cancer" and "cancerous" refer to or describe the physiological condition in mammals that is typically characterized by unregulated cell growth. Examples of cancer include, but are not limited to B-cell lymphomas (Hodgkin's lymphomas and/or non-Hodgkins lymphomas), T cell lymphomas, myeloma, myelodysplastic syndrome, myeloproliferative disorders (e.g., polycythemia vera, myelofibrosis, essential thrombocythemia etc.), skin cancer, brain tumor, breast cancer, colon cancer, rectal cancer, esophageal cancer, anal cancer, cancer of unknown primary site, endocrine cancer, testicular cancer, lung cancer, hepatocellular cancer, gastric cancer, pancreatic cancer, cervical cancer, ovarian cancer, liver cancer, bladder cancer, cancer of the urinary tract, cancer of reproductive organs thyroid cancer, renal cancer, carcinoma, melanoma, head and neck cancer, brain cancer (e.g., glioblastoma multiforme), prostate cancer, including but not limited to androgen-dependent prostate cancer and androgen-independent prostate cancer, and leukemia. Other cancer and cell proliferative disorders will be readily recognized in the art. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors. The term "cancer" is meant to include all types of cancerous growths or oncogenic processes, metastatic tissues or malignantly transformed cells, tissues, or organs, irrespective of histopathologic type or stage of invasiveness "Cell therapy" or "Cell-based therapy" or "Immune cell therapy" or Immune effector cell therapy" refers to a therapy that involves the use of cells for the prevention or treatment of a disease. Non-limiting examples of cell therapy include CAR-T cell therapy, NK-cell therapy, recombinant TCR-T cell therapy, TIL (tumor infiltrating lymphocytes). Biological agents, such as antibodies (e.g., Bispecific T cell engagers and DARTs etc.) which mediate their effect by binding to and/or activating immune cells (e.g, T cells and NK cells) are other examples of cell therapies. Stem cell and organ transplants, including autologous and allogeneic blood and marrow transplants, are also examples of cell therapies.

"Chemotherapeutic agents" are compounds that are known to be of use in chemotherapy for cancer. Non-limiting examples of chemotherapeutic agents can include alkylating agents such as thiotepa and CYTOXAN® cyclosphosphamide; alkyl sulfonates such as busulfan, improsulfan and piposulfan; a camptothecin (including the synthetic analogue topotecan); bryostatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gamma1I and calicheamicin omegaI1 (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE® Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE; vinorelbine; novantrone; teniposide; edatrexate; daunomycin; aminopterin; xeloda; ibandronate; irinotecan (Camptosar, CPT-11); topoisomerase inhibitor RFS 2000; difluoromethylornithine (DMFO); retinoids such as retinoic acid; capecitabine; combretastatin; leucovorin (LV); oxaliplatin, lapatinib (Tykerb); inhibitors of PKC-alpha, Raf, H-Ras, EGFR (e.g., erlotinib (Tarceva®)) and VEGF-A that reduce cell proliferation and pharmaceutically acceptable salts, acids or derivatives of any of the above or combinations thereof.

"Chimeric antigen receptors" (CARs) are artificial (non-naturally occurring) immune cell (e.g., T cell) receptors contemplated for use as a therapy for cancer, using a technique called adoptive cell transfer. CARs are also known as artificial T-cell receptors, chimeric T-cell receptors or chimeric immunoreceptors. CARs are constructed specifically to stimulate T cell activation and proliferation in response to a specific antigen to which the CAR binds. Generally, a CAR refers to a set of polypeptides, typically two in the simplest embodiments, which when expressed in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule. In some aspects, the set of polypeptides are contiguous with each other. In one aspect, the stimulatory molecule is the zeta chain associated with the T cell receptor complex. In one aspect, the cytoplasmic signaling domain further comprises one or more functional signaling domains derived from at least one costimulatory molecule as defined below. In one embodiment, the costimulatory molecule is chosen from the costimulatory molecules described herein, e.g., 4-1BB (i.e., CD137), CD27 and/or CD28. In one embodiment, the CAR comprises an optional leader sequence at the amino-terminus (N-ter) of the CAR fusion protein. In one embodiment, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane. In various embodiments, CARs are recombinant polypeptides comprising an antigen-specific domain (ASD), a hinge region (HR), a transmembrane domain (TMD), an optional co-stimulatory domain (CSD) and an intracellular signaling domain (ISD). The optional costimulatory domain is generally absent in the 1st generation CAR constructs. The nucleic acid sequences of several exemplary 2nd generation CARs comprising the different antigen binding domains (e.g., vL and vH fragments, vHH, ligands and receptors etc.) described in this disclosure and incorporating the 41BB costimulatory domain are presented in SEQ ID NO: 1455-1703 (Table 8). The corresponding amino acid sequences are provided in SEQ ID NO: 7341-7589. The order of the antigen binding domains contained in the different constructs encoding scFv, CARs, AMR listed in Table 8 is the same as the order of the scFvs presented in Table 7. Thus, the amino acid and nucleic acid SEQ ID NO of a construct belonging to a given architecture (e.g., scFv-KDEL, a second generation CAR, or an AMR etc.) and containing a specific antigen-binding domain can be determined by examination of Tables 7 and Table 8. Thus, Table 7 shows that a scFv containing the huFMC63-11-(vL-vH) antigen binding domain is the $2^{nd}$ construct and is represented by nucleic acid and amino acid SEQ ID NOs: 206 and 6092, respectively. The nucleic acid and amino acid SEQ ID Nos of huFMC63-11 containing scFv-KDEL and $2^{nd}$ generation BBz CAR architecture can be determine by examination of Table 8 which shows that the $2^{nd}$ construct on these architecture has the nucleic acid SEQ ID NOs: 456 and 1456, respectively and amino acid SEQ ID Nos: 6342 and 7342, respectively. A similar approach can be used to determine the nucleic acid and amino acid SEQ ID Nos of other constructs belonging to different architectures listed in Table 8. Unless specified otherwise, as used herein, the term "CAR" or "CARs" also encompasses newer approaches to conferring antigen specificity onto cells, such as Antibody-TCR chimeric molecules or Ab-TCR (WO 2017/070608 A1 incorporated herein by reference), TCR receptor fusion proteins or TFP (WO 2016/187349 A1 incorporated herein by reference), Synthetic Immune Receptors (SIRs) (see, WO 2018/102795 A1, incorporated herein by reference), Tri-functional T cell antigen coupler (Tri-TAC or TAC) (see, WO 2015/117229 A1, incorporated herein by reference). The nucleic acid sequences of several exemplary TFPs comprising the different antigen binding domains (e.g., vL and vH fragments, vHH, ligands and receptors etc.) described in this disclosure and based on CD3ε, CD3δ, CD3γ and CD3ζ chains and co-expressing the optional accessory module NEMO-K277A are presented in SEQ ID NO:1900-2205, 2206-2511, 2512-2817, 2818-3123, respectively (Table 13) of PCT/US18/53247, which is incorporated in its entirety by reference herein. The order of the antigen binding domains contained in the construct of different CAR architectures and BiTE listed in Table 13 of PCT/US18/53247, which is incorporated in its entirety by reference herein is the same as the order of the constructs on the zCAR-K277A architecture presented in Table 12 of PCT/US18/53247, which is incorporated in its entirety by reference herein. Typically, the term "CAR-T cell" is used, to refer to T-cells that have been engineered to express a chimeric antigen receptor. Thus, T lymphocytes bearing such CARs are generally referred to as CAR-T lymphocytes. CARs can be also expressed in cells other than T cells, such as hematopoietic stem cells, induced pluripotent stem cells (iPSC), NK cells and macrophage.

"Codon optimization" or "controlling for species codon bias" refers to the preferred codon usage of a particular host cell. As will be understood by those of skill in the art, it can be advantageous to modify a coding sequence to enhance its expression in a particular host. The genetic code is redundant with 64 possible codons, but most organisms typically use a subset of these codons. The codons that are utilized most often in a species are called optimal codons, and those not utilized very often are classified as rare or low-usage codons.

Optimized coding sequences containing codons preferred by a particular prokaryotic or eukaryotic host (see also, Murray et al. (1989) Nucl. Acids Res. 17:477-508) can be prepared, for example, to increase the rate of translation or to produce recombinant RNA transcripts having desirable properties, such as a longer half-life, as compared with transcripts produced from a non-optimized sequence. Translation stop codons can also be modified to reflect host preference. Those of skill in the art will recognize that, due to the degenerate nature of the genetic code, a variety of DNA compounds differing in their nucleotide sequences can be used to encode a given polypeptide of the disclosure.

As used herein, "co-express" refers to expression of two or more polynucleotides or genes. Genes may be nucleic acids encoding, for example, a single protein or a chimeric protein as a single polypeptide chain. A CAR or a TCR described herein may be encoded by a single polynucleotide chain and expressed as single polypeptide chain, which is subsequently cleaved into different polypeptides, each representing a distinct functional unit. In some embodiments, where the CAR or a TCR consists of two or more functional polypeptide units, the different functional units are coexpressed using one or more polynucleotide chains. In one embodiment, costimulation is provided by an accessory module that is co-expressed with the AMR, CAR or a TCR but is not an integral part of the AMR, CAR or TCR polypeptide. In another embodiment, the different polynucleotide chains are linked by nucleic acid sequences that encode for cleavable linkers (e.g. T2A, F2A, P2A, E2A etc.) (Table 6). In another embodiment, a Ser-Gly-Ser-Gly (SGSG) motif (SEQ ID NO: 55) is also added upstream of the cleavable linker sequences to enhance the efficiency of cleavage. The polynucleotides encoding the different units of a CAR or a TCR may be linked by IRES (Internal Ribosomal Entry Site) sequences. Alternately, the different functional units of a CAR or TCR are encoded by two different polynucleotides that are not linked via a linker but are instead encoded by, for example, two different vectors. The nucleic acid and amino acid sequences of exemplary cleavable linkers and Furine cleavage sites are provided in Table 6.

A "conservative substitution" or "conservative sequence modifications" refers to amino acid modifications that do not significantly affect or alter the binding characteristics or function of the encoded protein. For example, "conservative sequence modifications" refers to amino acid modifications that do not significantly affect or alter the binding characteristics or function of a CAR construct of the disclosure (e.g., a conservative change in the constant chain, antibody, antibody fragment, or non-immunoglobulin binding domains). Such conservative modifications include amino acid substitutions, additions and deletions. Modifications can be introduced by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the disclosure can be replaced with other amino acid residues from the same side chain family and the altered CAR can be tested using the binding and/or functional assays described herein.

The term "constant region of T cell receptor-alpha" or "constant chain of T cell receptor-alpha" or "TCRα" or "Cα" is defined as the protein provided as SEQ ID NO: 5966 or the equivalent residues (i.e., a homolog) from a non-human species, e.g., mouse, rodent, monkey, ape and the like. The disclosure also provides certain mutations to TCRα polypeptides which can be used in the construction of SIRs and Ab-TCR (Tables 3 and 6). For example, sites of mutation in Cα that demonstrate increased expression and decreased mispairing are located at positions 91, 92, 93, and 94 of SEQ ID NO 5966. A TCR polypeptide with a Thr 48 Cys (T48C) mutation in Cα and a Ser-57-Cys (S57C) mutation in Cβ1 or Cβ2 chain (described more fully elsewhere herein) results in an additional disulfide bond between the two TCR constant chains (α and β). This, in turn, results in reduced mispairing with endogenous TCR chains in an immune cell and enhanced functionality. Similarly, a SIR with a Ser 61 Arg (S61R) mutation in Cα and an Arg 79 Gly (R79G) mutation in Cβ1 or Cβ2 chain (described more fully elsewhere herein) results in reduced mispairing with the endogenous TCR chains and enhanced functionality due to a "knob and hole" design for pairing. A SIR or an Ab-TCR with a R120L mutation or with double mutations G127L and N129A has altered sensitivity when exposed to its target antigen. The SEQ ID NOs of exemplary SIRs and Ab-TCRs with R120L mutation or with G127L and N129A double mutations and their targeted antigens are provided in Tables 13 and 14. The order of the target antigens of the constructs listed in Table 14 is the same as the order of the constructs listed in Table 13 and therefore the target antigens of the constructs listed in Table 14 can be determined by reference to Table 13. The disclosure provides Cα polypeptides having one or more or all of the mutations according to Table 3 below and Table 6 which can be used in the construction of SIRs and Ab-TCR.

TABLE 3

Mutations according to the disclosure in the human constant TCR-alpha region (Cα)

| Position (SEQ ID NO: 5966) | Amino acid in wild-type | Mutation | TYPE |
|---|---|---|---|
| 10 | Y | C | disulfide bond |
| 15 | S | C | disulfide bond |
| 45 | T | C | disulfide bond |
| 48 | T | C | disulfide bond |
| 61 | S | R | Knob into Hole |
| 91 | P | S | Murinization |
| 92 | E | D | Murinization |
| 93 | S | V | Murinization |
| 94 | S | P | Murinization |
| 120 | R | L | Increased sensitivity |
| 127 | G | L | Increased sensitivity |
| 129 | N | A | Increased sensitivity |

The human genome encodes for two highly homologous TCR beta constant chains; TCR beta1 (TCRβ1 or TCRb1 or cβ1) and TCR beta 2 (TCRβ2 or TCRb2 or cβ2). The CARs (e.g., SIR, Ab-TCR or TFP) of the disclosure can comprise either of these two chains. Similarly, either TCR beta1 or TCR beta2 chains of other mammalian species can be used in the methods of the disclosure.

The term "constant chain of T cell receptor-beta 1" or "constant region of T cell receptor-beta 1" (TCR-beta1 or TCRβ1 or TCRb1 or hTCR-beta1 or Cβ1) is defined as a protein provided as SEQ ID NO: 5973 or the equivalent residues (i.e., a homolog) from a non-human species, e.g., mouse, rodent, monkey, ape and the like.

The term "constant chain of T cell receptor-beta 2" or "constant region of T cell receptor-beta 2" (TCR-beta2 or TCRβ2 or TCRb2 or Cβ2) is defined as the protein provided as SEQ ID NO: 5974 or the equivalent residues (i.e., a homolog) from a non-human species, e.g., mouse, rodent, monkey, ape and the like.

The term "constant chain of T cell receptor-beta" or "constant region of T cell receptor-beta" (TCR-beta or TCRβ or TCRb or Cβ)" is defined as the protein provided as SEQ ID NO: 5973 or 5974 or the equivalent residues (i.e., a homolog) from a non-human species, e.g., mouse, rodent, monkey, ape and the like.

The protein sequences for both Cβ2 (SEQ ID NO: 5974) and Cβ1 (SEQ ID NO: 5973) are known (Table 6). Differences between the sequences of Cβ2 and β1 are easily identified by alignment of the sequences using typical and ordinary skill in the art. The disclosure also provides certain mutations to TCRβ's that can be used in the construction of SIRs and Ab-TCRs. For example, sites of mutation in Cβs that demonstrate increased expression and decreased mispairing with the endogenous TCRα chains are provided herein. These mutation sites in Cβ1 and Cβ2 are located at positions 18, 22, 57, 79 133, 136, and 139 of SEQ ID NOs: 5973 and 5974 and are summarized in the Tables 4 and 5 below. The mutation sites in Cβ1 and Cβ2 are identical in their positions. The only difference between the two sequences is that a mutation at position 136. At this position, a glutamic acid (E) is present in Cβ2, whereas a valine is present in Cβ1.

TABLE 4

Mutations according to the disclosure in the human constant TCR-beta region1 (Cβ1)

| Position (SEQ ID NO: 5973) | Amino acid in wild-type | Mutation | TYPE |
|---|---|---|---|
| 15 | E | C | disulfide bond |
| 17 | S | C | disulfide bond |
| 18 | E | K or R | Murinization |
| 22 | S | A | Murinization |
| 57 | S | C | disulfide bond |
| 59 | D | C | disulfide bond |
| 77 | S | C | disulfide bond |
| 79 | R | G | Knob into Hole |
| 133 | F | I | Murinization |
| 136 | V | A | Murinization |
| 139 | Q | H | Murinization |

TABLE 5

Mutations according to the disclosure in the human constant TCR-beta region2 (Cβ2)

| Position (SEQ ID NO: 5974) | Amino acid in wild-type | Mutation | TYPE |
|---|---|---|---|
| 15 | E | C | disulfide bond |
| 17 | S | C | disulfide bond |
| 18 | E | K or R | Murinization |
| 22 | S | A | Murinization |
| 57 | S | C | disulfide bond |
| 59 | D | C | disulfide bond |
| 77 | S | C | disulfide bond |
| 79 | R | G | Knob into Hole |
| 133 | F | I | Murinization |

TABLE 5-continued

Mutations according to the disclosure in the human constant TCR-beta region2 (Cβ2)

| Position (SEQ ID NO: 5974) | Amino acid in wild-type | Mutation | TYPE |
|---|---|---|---|
| 136 | E | A | Murinization |
| 139 | Q | H | Murinization |

The term "constant chain of TCR-gamma" or "constant region of TCR-gamma" (TCR-gamma or TCRγ or TCRg or TCR-gamma1 or TCRγ1 or TCRg1 or Cγ) is defined as the protein provided as SEQ ID NO: 5981 or the equivalent residues (i.e., a homolog) from a non-human species, e.g., mouse, rodent, monkey, ape and the like.

The term "constant chain of TCR-delta" or "constant region of TCR-delta" (TCR-delta or TCRδ or TCRd or Cδ) is defined as the proteins provided as SEQ ID NO: 5982 or the equivalent residues (i.e., a homolog) from a non-human species, e.g., mouse, rodent, monkey, ape and the like.

It will be recognized that proteins can have identity or homology to one another and retain similar or identical functions. The disclosure includes TCR constant regions that have 85%, 90%, 95%, 97%, 98%, 98.5%, 99% or 99.9% identity to any of the sequences described herein while retaining the biological activity.

Accordingly, the disclosure provides a T-cell receptor constant chain having a sequence selected from the group consisting of: (a) an amino acid sequence that is at least 85% identical to SEQ ID NO: 5966 and which can have one or more mutations at positions 61, 91, 92, 93, 94, 120, 127 and/or 129; (b) an amino acid sequence that is at least 85% identical to SEQ ID NO:5973 and can have one or more mutations at positions 18, 22, 57, 79, 133, 136 and/or 139; (c) an amino acid sequence that is at least 85% identical to SEQ ID NO:5974 and can have one or more mutations at position 18, 22, 57, 79, 133, 136 and/or 139; (d) an amino acid sequence that is at least 85% identical to SEQ ID NO:5980; and (e) an amino acid sequence that is at least 85% identical to SEQ ID NO:5981. The T-cell receptor constant chains of any of (a)-(e) retain at least one biological activity of the wild-type T-cell receptor constant chain to which it has identity or homology.

In one embodiment, a modified TCR is selected from the group consisting of a wild-type TCR, a high affinity TCR, and a chimeric TCR. In another embodiment, the modified TCR comprises at least one extra disulfide bond. In yet another embodiment, the modified TCR comprises a TCR alpha chain and TCR beta chain. In still another embodiment, the modified TCR comprises a co-stimulatory signaling domain, such as a 4-1BB co-stimulatory signaling domain, at a C' terminal of at least one of the chains. In another embodiment, the TCR beta chain comprises at least one N-deglycosylation. In yet another embodiment, the TCR alpha chain comprises at least one N-deglycosylation. In still another embodiment, the modified TCR comprises at least one murine constant region.

In another embodiment, the modified TCR has higher affinity for the target cell surface antigen than for a wildtype TCR. In still another embodiment, the target cell surface antigen is selected from the group consisting of viral antigen, bacterial antigen, parasitic antigen, tumor cell associated antigen (TAA), disease cell associated antigen, and any fragment thereof.

The term "constitutively active" refers to a molecule, e.g., a protein that has signaling activity without the need of a stimulus. Exemplary constitutive active proteins are NEMO-K277A and vFLIP K13 as they can activate NF-κB signaling when expressed in a suitable cell without the need of an additional stimulus.

"Co-stimulatory domain" (CSD) as used herein refers to the portion of an AMR which enhances the proliferation, survival and/or development of T cells. The AMRs of the disclosure may comprise one or more co-stimulatory domains. Each co-stimulatory domain comprises the costimulatory domain of any one or more of, for example, members of the TNFR superfamily, CD28, CD137 (4-1BB), CD134 (OX40), Dap10, CD27, CD2, CD5, ICAM-1, LFA-1(CD11a/CD18), Lck, TNFR-I, TNFR-II, Fas, CD30, CD40 or combinations thereof. Other co-stimulatory domains (e.g., from other proteins) will be apparent to those of skill in the art and may be used in connection with alternate embodiments of the disclosure. In one embodiment, a CAR may act as an AMR.

The term a "costimulatory molecule" or a "costimulatory receptor" refers to a cognate binding partner on a T cell that specifically binds with a costimulatory ligand, thereby mediating a costimulatory response by the T cell, such as, but not limited to, proliferation. Costimulatory extracellular molecules are cell surface molecules other than antigen receptors or their ligands that contribute to an efficient immune response. Costimulatory molecules include, but are not limited to, an MHC class I molecule, BTLA and a Toll ligand receptor, as well as OX40, Dap10, CD27, CD28, CD2, CD5, CD8, ICAM-1, LFA-1 (CD11a/CD18), ICOS (CD278), Lck, TNFR-I, TNFR-II, Fas, CD30, CD40 and 4-1BB (CD137). A co-stimulatory receptor may be expressed on cells other T cells, such as NK cells or macrophages.

A "costimulatory intracellular signaling domain" or "costimulatory domain" (CSD) can be the intracellular portion of a costimulatory receptor. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, ICAM-1, lymphocyte function-associated antigen-1 (LFA-1), CD2, CD8, CD7, CD287, LIGHT, NKG2C, NKG2D, SLAMF7, NKp80, NKp30, NKp44, NKp46, CD160, B7-H3, and a ligand that specifically binds with CD83, and the like. The intracellular signaling domain can comprise the entire intracellular portion, or the entire native intracellular signaling domain, of the molecule from which it is derived, or a functional fragment or derivative thereof. The CARs of the disclosure may comprise one or more co-stimulatory domains.

The term "cTCR" refers to a wild-type TCR nucleic acid coding sequence and the corresponding wild-type TCR protein linked to an antigen binding domain. cTCRs are used in some embodiments and as reference controls. For example, a cTCR having a CD19 binding domain and a CD19-SIR (comprising a mutant TCR chain and CD19 binding domain) will have different expression and/or difference binding affinities to the target antigen.

The term "cytosolic" or "cytoplasmic" refers to an agent, e.g., a protein that is situated in the cytoplasm of a cell in its mature form. A cytosolic protein can translocate into the nucleus but is not a transmembrane protein and is not secreted outside the cell. An exemplary cytosolic protein is MC159 (SEQ ID NO: 5961).

Cytokine Release Syndrome (CRS) is a complication of cell therapies (e.g., CAR-T, bispecific T cell engaging antibodies etc.) that manifests itself with a constellation of signs and symptoms such as fever, hypotension, shortness of breath, renal dysfunction, pulmonary dysfunction and/or capillary leak syndrome. CRS is usually due to excessive production of cytokines, such as IL6 and IL1.

The term "degenerative disorders" refers to a disease that is the result of a continuous process based on degenerative cell changes, affecting tissues or organs, which will increasingly deteriorate over time, whether due to normal bodily wear or lifestyle choices such as exercise or eating habits. Exemplary degenerative diseases include Alzheimer's disease, Creutzfeldt-Jakob disease, Diabetes mellitus (type II), and Atherosclerosis.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an antigen binding domain that is derived from an antibody molecule, the antigen binding domain retains sufficient antibody structure such that is has the required function, namely, the ability to bind to an antigen. It does not connotate or include a limitation to a particular process of producing the antibody, e.g., it does not mean that, to provide the antigen binding domain, one must start with an antibody sequence and delete unwanted sequence, or impose mutations, to arrive at the antigen binding domain.

"Dimerization molecule," as that term is used herein refers to a molecule that promotes the association of a first switch domain with a second switch domain. In embodiments, the dimerization molecule does not naturally occur in the subject, or does not occur in concentrations that would result in significant dimerization. In embodiments, the dimerization molecule is a small molecule, e.g., rapamycin or a rapalogue, e.g, RAD001, Rimiducid or AP20187. Rimiducid (AP1903) is a lipid-permeable tacrolimus analogue with homodimerizing activity. Rimiducid homodimerizes an analogue of human protein FKBP12 (Fv) which contains a single acid substitution (Phe36Val). Rimiducid is used to homodimerize the Fv-containing drug-binding domains of non-naturally occurring immune receptor resulting in downstream signaling activation during cell therapy. Rimiducid can be at about 0.01-1 mg/kg and has an EC50 in cell culture of about 0.1 nM. AP20187 can be administered from about 2-10 mg/kg/day in single or multi-doses.

The phrase "disease associated with expression of a target antigen" or "disease associated antigen as described herein" includes, but is not limited to, a disease associated with expression of a target antigen as described herein or condition associated with cells which express a target antigen as described herein including, e.g., proliferative diseases such as a cancer or malignancy or a precancerous condition such as a myelodysplasia, a myelodysplastic syndrome or myeloproliferative disorder or a pre leukemia; or a noncancer related indication associated with cells which express a target antigen as described herein. In one aspect, a cancer associated with expression of a tumor antigen as described herein is a hematological cancer. In one aspect, a cancer associated with expression of a tumor antigen as described herein is a solid cancer. Further diseases associated with expression of a tumor antigen described herein include, but are not limited to, atypical and/or non-classical cancers, malignancies, precancerous conditions or proliferative diseases associated with expression of a tumor antigen as described herein. Non-cancer related indications associated with expression of a target antigen as described herein include, but are not limited to, e.g., autoimmune disease, (e.g., lupus), inflammatory disorders (allergy and asthma) and transplantation. In some embodiments, the target antigen-expressing cells express, or at any time expressed, mRNA encoding the target antigen. In another embodiment, the target antigen-expressing cells produce the target antigen protein (e.g., wild-type or mutant), and the target antigen protein may be present at normal levels or reduced levels. In another embodiment, the target antigen-expressing cells produced detectable levels of a target antigen protein at one point, and subsequently produced substantially no detectable target antigen protein.

"Disease targeted by genetically modified cells" as used herein encompasses the targeting of any cell involved in any manner in any disease by the genetically modified cells of the disclosure, irrespective of whether the genetically modified cells target diseased cells or healthy cells to effectuate a therapeutically beneficial result. The genetically modified cells include, but are not limited to, genetically modified T-cells, NK cells, hematopoietic stem cells, pluripotent embryonic stem cells, induced pluripotent stem cells (iPSC) or embryonic stem cells. The genetically modified cells express the conventional CARs and novel backbones containing conventional CARs with accessory modules of the disclosure, which CARs may target any of the antigens expressed on the surface of target cells. Examples of antigens which may be targeted include, but are not limited to, antigens expressed on B-cells; antigens expressed on carcinomas, sarcomas, lymphomas, leukemia, germ cell tumors, and blastomas; antigens expressed on various immune cells; and antigens expressed on cells associated with various hematologic diseases, autoimmune diseases, and/or inflammatory diseases. Other antigens that may be targeted will be apparent to those of skill in the art and may be targeted by the CARs of the disclosure in connection with alternate embodiments thereof.

The term "Dissociation constant (Kd)" is defined as the equilibrium constant of the dissociation of a receptor-ligand (e.g., binding domain—cognate) interaction.

As used herein a "diverse set of non-naturally occurring immune receptors" or "diverse set of SIRs" or "diverse set of CARs" refers to a plurality of non-naturally occurring immune receptors having the same binding domain linked to a diverse set of T cell receptor constant chains or "backbones" wherein each construct comprising a binding domain and a different T cell constant chain or backbone provide a diverse range of binding to a target antigen and/or varied expression levels. For example, depending upon the mutation composition of the constant domain (e.g., mutant TCRa+TCRb), the binding affinity of the binding domain to its target varies. In some embodiments, a SIR of the disclosure (single strand or heterodimer) comprises a binding affinity that is greater than a wild-type TCR (e.g., cTCR) with the same binding domain. In one embodiment, a SIR has a higher expression level than a cTCR by at least 1.25 fold to about 10,000 fold higher (and any number in between), wherein the SIR and cTCR differ only in the mutation in the TCR domain. In another embodiment, a SIR has a binding affinity for a target that is at least 1.5 fold higher to about 10,000 fold higher than a cTCR having a binding domain to the same antigen. In yet another embodiment, the SIR has a higher binding affinity than a cTCR to the same antigen, but less than a chimeric antigen receptor (CAR) having the same binding domain. In some embodiments, the binding of a SIR expressing effector cell to the target antigen is at least 1.25-fold more than the binding of a corresponding cTCR-expressing effector cell but less than 100,000 fold more than the corresponding cTCR. In some embodiment, the antigen binding domain has a disassociation constant ($K_D$, reflecting its binding affinity) from between about $10^{-4}$ M to $10^{-8}$M. In some embodiments, the antigen binding domain binds to one or more of the antigens recited above. In some embodiment, the antigen binding domain has a $K_D$ of between about $10^{-4}$ M to $10^{-8}$ M, e.g., between about $10^{-5}$M to $10^{-7}$M, e.g., between about $10^{-5}$M to $10^{-6}$ M, for the target antigen. In one embodiment, the binding affinity of the antigen binding domain is at least five-fold, 10-fold, 20-fold, 30-fold, 50-fold, 100-fold or 1,000-fold less than a reference antibody. In one embodiment, the encoded antigen binding domain has a binding affinity at least 5-fold less than a reference antibody. In some embodiments, the reference antibody is an antibody from which the antigen binding domain is derived. For example, the disclosure contemplates a diverse population of SIRs against a particular antigen target that can be designed and screened based upon the nucleic acid sequence codon optimization and/or the mutation in the TCR chain to promote pairing or expression and/or the use of a linker between the binding domain and the TCR domain.

As used herein, an "epitope" is defined to be the portion of an antigen capable of eliciting an immune response, or the portion of an antigen that binds to an antibody or antibody fragment. Epitopes can be a protein sequence or subsequence.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adena-associated viruses) that incorporate the recombinant polynucleotide.

The term "functional portion" when used in reference to an AMR or a CAR refers to any part or fragment of the AMR or CAR, which part or fragment retains the biological activity of the AMR or CAR of which it is a part (the parent AMR or CAR). Functional portions encompass, for example, those parts of a AMR or CAR that retain the ability to recognize target cells, or detect, treat, or prevent a disease, to a similar extent, the same extent, or to a higher extent, as the parent AMR or CAR. In reference to the parent AMR or CAR, the functional portion can comprise, for instance, about 10%, 25%, 30%, 50%, 68%, 80%, 90%, 95%, or more, of the parent AMR or CAR.

"Genetically modified cells", "redirected cells", "genetically engineered cells" or "modified cells" as used herein refer to cells that express an AMR and/or CAR of the disclosure. In some embodiments, the genetically modified cells comprise vectors that encode an AMR and/or a CAR. In some embodiments, the genetically modified cells comprise vectors that encode an AMR and/or CAR and one or more accessory molecules (e.g., PDL1, PDL2, crmA, MC159 etc.) in the same vector. In some embodiments, the genetically modified cells comprise a first vector that encodes an AMR and/or CAR and a second vector that encodes the accessory molecule. In some embodiments, the genetically modified cells comprise a first vector that encodes an AMR and/or CAR and a second vector that encodes more than one accessory molecule. In some embodiments, the genetically modified cells comprise a first vector that encodes an AMR and/or CAR and a second vector that encodes the first accessory molecule and a third vector that encodes a second accessory molecule.

"Hinge region" (HR) as used herein refers to the hydrophilic region which is between the antigen binding domain and the transmembrane domain of an AMR and/or a CAR. The hinge regions include but are not limited to Fc fragments of antibodies or fragments or derivatives thereof, hinge regions of antibodies or fragments or derivatives thereof, CH2 regions of antibodies, CH3 regions of antibodies, artificial spacer sequences or combinations thereof. Examples of hinge regions include but are not limited to CD8a hinge, and artificial spacers made of polypeptides which may be as small as, for example, Gly3 or CH1 and CH3 domains of IgGs (such as human IgG4). In some embodiments, the hinge region is any one or more of (i) a hinge, CH2 and CH3 regions of IgG4, (ii) a hinge region of IgG4, (iii) a hinge and CH2 of IgG4, (iv) a hinge region of CD8a, (v) a hinge, CH2 and CH3 regions of IgG1, (vi) a hinge region of IgG1 or (vi) a hinge and CH2 region of IgG1. Other hinge regions will be apparent to those of skill in the art and may be used in connection with alternate embodiments of the disclosure.

"Immune cell" as used herein refers to the cells of the mammalian immune system including but not limited to antigen presenting cells, B-cells, basophils, cytotoxic T-cells, dendritic cells, eosinophils, granulocytes, helper T-cells, leukocytes, lymphocytes, macrophages, mast cells, memory cells, monocytes, natural killer cells, neutrophils, phagocytes, plasma cells and T-cells.

The term "immune disorder" refers to a disease characterized by dysfunction of immune system. An autoimmune disease is a condition arising from an abnormal immune response to a normal body part. There are at least 80 types of autoimmune diseases.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function" or "immune effector response," "effector function" refers to the specialized function of a differentiated cell. Effector function of a T-cell, for example, may be cytolytic activity or helper activity including the secretion of cytokines. For example, an immune effector function or response refers a property of a T or NK cell that promotes killing or the inhibition of growth or proliferation, of a target cell. In the case of a T cell, primary stimulation and co-stimulation are examples of immune effector function or response. In case of antigen presenting cells (e.g., dendritic cells) antigen presentation and cytokine secretion are examples of effector functions.

"Immune modulating agent (IMA)" as used herein refers to an agent that interferes with the interaction between an immune effector cell (e.g., CAR-T cell or T cell exposed to T cell activating bispecific/multispecific antibody or an NK cell exposed to an NKp46-bispecific NK cell engagers etc.) and the target antigen (e.g., CD19, CD20 etc.) or the target antigen expressing cells (e.g., CD19-expressing cancer cells). An exemplary IMA is a scFv-His protein targeting CD19 and is represented by SEQ ID NO: 705. Another exemplary IMA is a scFv targeting CD3 and is represented by SEQ ID NO: 6336. The nucleic acid and amino acid sequences of several IMA incorporating scFv proteins targeting different antigens are provided in SEQ ID NOs (DNA): 205-453 and SEQ ID NOs (PRT): 6091-6339 (Table 7). The nucleic acid and amino acid sequences of several IMA incorporating scFv-His proteins targeting different antigens are provided in SEQ ID NOs (DNA): 705-953 and SEQ ID NOs (PRT): 6591-6839 (Table 8). The target antigens of these scFv-His IMAs can be determined from Table 7 as the order of these IMAs and their target antigens is the same as the order of scFv and their target antigens shown in Table 7. It is to be noted that the His tag in the above IMA proteins are included to aid in protein purification but are not needed for their function as an immune modulating agent and therefore can be deleted without compromising their function.

"Immune response" as used herein refers to immunities including but not limited to innate immunity, humoral immunity, cellular immunity, immunity, inflammatory response, acquired (adaptive) immunity, autoimmunity and/or overactive immunity.

An "intracellular signaling domain," (ISD) or "cytoplasmic domain" as the term is used herein, refers to an intracellular signaling portion of a molecule. The intracellular signaling domain generates a signal that promotes an immune effector function of the cell. Examples of immune effector function include cytolytic activity and helper activity, including the secretion of cytokines. Examples of domains that transduce the effector function signal include but are not limited to the z chain of the T-cell receptor complex or any of its homologs (e.g., h chain, FceR1g and b chains, MB1 (Iga) chain, B29 (Igb) chain, etc.), human CD3 zeta chain, CD3 polypeptides (D, d and e), syk family tyrosine kinases (Syk, ZAP 70, etc.), src family tyrosine kinases (Lck, Fyn, Lyn, etc.) and other molecules involved in T-cell transduction, such as CD2, CD5 and CD28. Other intracellular signaling domains will be apparent to those of skill in the art and may be used in connection with alternate embodiments of the disclosure.

In another embodiment, the intracellular signaling domain can comprise a primary intracellular signaling domain. Exemplary primary intracellular signaling domains include those derived from the molecules responsible for primary stimulation, or antigen dependent simulation. In another embodiment, the intracellular signaling domain can comprise a costimulatory intracellular domain. Exemplary costimulatory intracellular signaling domains include those derived from molecules responsible for costimulatory signals, or antigen independent stimulation. For example, a primary intracellular signaling domain can comprise a cytoplasmic sequence of CD3z, and a costimulatory intracellular signaling domain can comprise cytoplasmic sequence from co-receptor or costimulatory molecule, such as CD28 or 41BB.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, common FeR gamma (FCER1G), Fe gamma RIIa, FeR beta (Fe Epsilon R1b), CD3 gamma, CD3 delta, CD3 epsilon, CD79a, CD79b, DAP1O, and DAP12.

The term "isolated" as used herein refers to molecules or biologicals or cellular materials being substantially free from other materials. In one aspect, the term "isolated" refers to nucleic acid, such as DNA or RNA, or protein or polypeptide (e.g., an antibody or derivative thereof), or cell or cellular organelle, or tissue or organ, separated from other DNAs or RNAs, or proteins or polypeptides, or cells or cellular organelles, or tissues or organs, respectively, that are present in the natural source. The term "isolated" also refers to a nucleic acid or peptide that is substantially free of cellular material, viral material, or culture medium when produced by recombinant DNA techniques, or chemical precursors or other chemicals when chemically synthesized. Moreover, an "isolated nucleic acid" is meant to include nucleic acid fragments which are not naturally occurring as fragments and would not be found in the natural state. The term "isolated" is also used herein to refer to polypeptides which are isolated from other cellular proteins and is meant to encompass both purified and recombinant polypeptides. The term "isolated" is also used herein to refer to cells or tissues that are isolated from other cells or tissues and is meant to encompass both, cultured and engineered cells or tissues.

As used herein, the term "linker" (also "linker domain" or "linker region") refers to an oligo or a polypeptide (or an oligo encoding the polypeptide) that joins together two or more domains or regions of a CAR polynucleotide or polypeptide, respectively, disclosed herein. The linker can be anywhere from 1 to 500 amino acids in length or 3 to 1500 nucleotide in length. In some embodiments the "linker" is cleavable or non-cleavable. Unless specified otherwise, the term "linker" used herein means a non-cleavable linker. Said non-cleavable linkers may be composed of flexible residues which allow freedom of motion of adjacent protein domains relative to one another. Non-limiting examples of such residues include glycine and serine. In some embodiments, linkers include non-flexible residues. Examples of cleavable linkers include 2A linkers (for example T2A), 2A-like linkers or functional equivalents thereof and combinations thereof. In some embodiments, the linkers include the picornaviral 2A-like linker, CHYSEL sequences of porcine teschovirus (P2A), *Thosea asigna* virus (T2A) or combinations, variants and functional equivalents thereof. In some embodiments, the linker sequences may comprise a motif that results in cleavage between the 2A glycine and the 2B proline (see, e.g., T2A sequence, SEQ ID NO: 5936, C-terminal Gly-Pro). The nucleic sequences of several exemplary cleavable linkers are provided in SEQ ID NO: 49 to SEQ ID NO: 54 and amino acid sequences of several exemplary linkers are provided in SEQ ID NO: 5935 to SEQ ID NO: 5940. Other cleavable linkers that may be used herein are readily appreciated by those of skill in the art.

In an embodiment, a Ser-Gly-Ser-Gly (SGSG) motif (SEQ ID NOs: 5941) is also added upstream of the cleavable linker sequences to enhance the efficiency of cleavage. A potential drawback of the cleavable linkers is the possibility that the small 2A tag left at the end of the N-terminal protein may affect protein function or contribute to the antigenicity of the proteins. To overcome this limitation, in some embodiments, a furine cleavage site (RAKR) (SEQ ID NO: 5943) is added upstream of the SGSG motifs to facilitate cleavage of the residual 2A peptide following translation.

The term "flexible polypeptide linker" as used herein refers to a peptide linker that consists of amino acids such as glycine and/or serine residues used alone or in combination, to link polypeptide chains together (e.g., variable heavy and variable light chain regions together). In one embodiment, the flexible polypeptide linker is a Gly/Ser linker and comprises the amino acid sequence $(Gly\text{-}Gly\text{-}Gly\text{-}Ser)_n$, (e.g., SEQ ID NO:5906) where n is a positive integer equal to or greater than 1. For example, n=1, n=2, n=3. n=4, n=5 and n=6, n=7, n=8, n=9 and n=10. In one embodiment, the flexible polypeptide linkers include, but are not limited to, $(Gly_4Ser)_4$ or $(Gly_4Ser)_3$. Also included within the scope of the disclosure are linkers described in WO2012/138475, incorporated herein by reference).

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of *lenti* viruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art. Other examples of lentivirus vectors are pLENTI-EF1α (SEQ ID NO: 1), pLENTI-EF1α-DWPRE (SEQ ID NO: 2), pCCLc-MNDU3-WPRE (SEQ ID NO: 3) and pCCLc-MNDU3-Eco-Nhe-Sal-WPRE (SEQ ID NO: 4). In an exemplary embodiment, the nucleic acid fragment encoding an AMR, a CAR, CAR plus accessory module(s), or the accessory module(s) can be cloned between the Nhe I and Sal I sites present in the pLENTI-EF1α and the pCCLc-MNDU3-Eco-Nhe-Sal-WPRE vectors using methods known in the art.

"Mammal" as used herein refers to any member of the class Mammalia, including, without limitation, humans and nonhuman primates such as chimpanzees and other apes and monkey species; farm animals such as cattle, sheep, pigs, goats and horses; domestic mammals such as dogs and cats; laboratory animals including rodents such as mice, rats and guinea pigs, and the like. The term does not denote a particular age or sex. Thus, adult and newborn subjects, as well as fetuses, whether male or female, are intended to be included within the scope of this term.

The term "Membrane Anchored Polypeptide" or MAP as used herein refers to a polypeptide that is expressed on the cell surface. A MAP may be anchored to the cell membrane via a transmembrane domain or a via GPI linked anchor. Exemplary MAP include CAR, TFP, SIR, AMR, PDL1 etc. A MAP can be an endogenous polypeptide or a recombinant polypeptide.

"Native" or "Naturally occurring" or "endogenous" as used herein refers to a gene, protein, nucleic acid (e.g., DNA, RNA etc.) or fragment thereof that is native to a cell or is naturally expressed in a cell. Thus, a native or endogenous TCRα chain polypeptide of a T cell consists of a variable domain (Vα) joined to a TCRα constant chain. The native or endogenous TCRα chain precursor polypeptide also consists of an amino-terminal signal peptide that is cleaved from the mature polypeptide.

"NF-κB pathway" or "NF-κB signaling pathway" refers to a signal transducton pathway that results in the nuclear translocation of NF-κB subunits and transcriptional activation of NF-κB subunit responsive genes. An an alternative (or noncanonical) pathway of NF-κB activation, that involves proteasome-mediated processing of p100/NF-κB into p52 subunit, has been described.

"NF-κB stimulatory molecule" or "NF-κB stimulator" or "NF-κB activator" refers to a subset of accessory molecules that promote the activity of the NF-κB signaling pathway or the activity/expression of the downstream target genes of the NF-κB signaling pathway.

As used herein a "non-naturally occurring agent" or "non-native" or "exogenous" refers to an agent that is not naturally expressed in a cell. Stated another way, the non-naturally occurring agent is "engineered" to be expressed in a cell. A non-naturally occurring agent may be a cloned version of a naturally occurring agent. Exemplary non-naturally occurring agents include CARs, SIRs, Ab-TCRs, TFPs, recombinant TCR, NEMO-K277A, vFLIP-K13 and K13-opt. A non-naturally occurring agent may be expressed into a cell using techniques of gene transfer known in the art, such as lentiviral or retroviral mediated gene transfer. A non-naturally occurring agent may be expressed in an immune cell using an exogenous promoter (e.g., EF1α promoter) or an endogenous promoter (e.g., TCRα promoter). When an endogenous gene (e.g., IKK1, IKK2, IKKγ/NEMO) is cloned and ectopically expressed in a cell, it represents another example of a non-naturally occurring agent.

As used herein a "non-naturally occurring immune receptor" or "exogenous immune receptor" refers to an immune receptor that is not naturally expressed in an immune cell. Stated another way, the non-naturally occurring immune receptor is "engineered" to be expressed in an immune cell. A non-naturally occurring immune receptor may be a cloned version of a naturally occurring immune receptor. Alternatively, a non-naturally occurring immune receptor may be a chimeric receptor that is produced using recombinant molecular biology techniques. Exemplary non-naturally occurring immune receptors include CARs, SIR, Ab-TCRs, TFPs and recombinant TCR. A non-naturally occurring immune receptor may be introduced into an immune cell using techniques of gene transfer known in the art, such as lentiviral or retroviral mediated gene transfer. A non-naturally occurring immune receptor may be expressed in an immune cell using an exogenous promoter (e.g., EF1α promoter) or an endogenous promoter (e.g., TCRα promoter).

As used herein a "non-naturally occurring TCR antigen binding domain" or "exogenous TCR antigen binding domain" refers to a binding domain operably linked to a TCR constant region that is chimeric and non-naturally occurring with respect to a TCR present in nature. Stated another way, the non-naturally occurring TCR antigen binding domain is "engineered" using recombinant molecular biology techniques to be operably linked to a TCR and moreover, that the antigen binding domain is obtain or derived from a molecule that is distinct from a TCR found in nature. An antigen binding domain that is distinct from a TCR in nature includes antibody vH and vL fragments, humanized antibody fragments, chimeric antibody fragments, receptor ligands, and the like.

The term "operably linked" or "functionally linked" refers to functional linkage or association between a first component and a second component such that each component can be functional. For example, operably linked includes the association between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. In the context of two polypeptides that are operably linked a first polypeptide functions in the manner it would independent of any linkage and the second polypeptide functions as it would absent a linkage between the two.

"Percent identity" in the context of two or more nucleic acids or polypeptide sequences, refers to two or more sequences that are the same. Two sequences are "substantially identical" if two sequences have a specified percentage of amino acid residues or nucleotides that are the same (e.g., 60% identity, optionally 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more typically over a region that is 100 to 500 or 1000 or more nucleotides (or 20, 50, 200 or more amino acids) in length.

For sequence comparison, generally one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Bioi. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, WI), or by manual alignment and visual inspection (see, e.g., Brent et al., (2003) Current Protocols in Molecular Biology).

Two examples of algorithms that can be used for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Bioi. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Bioi. 48:444-453) algorithm which has been incorporated into the GAP program in the GCG software package (available at www.gcg.com), using either a Blossom 62 matrix or a P-AM250 matrix, and a gap weight of 16, 14, 12, 10, 8, 6, or 4 and a length weight of 1, 2, 3, 4, 5, or 6.

The term "retrovirus vector" refers to a vector derived from at least a portion of a retrovirus genome. Examples of retrovirus vector include MSCVneo, MSCV-pac (or MSCV-puro), MSCV-hygro as available from Addgene or Clontech.

The term "Sleeping Beauty Transposon" or "Sleeping Beauty Transposon Vector" refers to a vector derived from at least a portion of a Sleeping Beauty Transposon genome.

The term "single chain variable region" or "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the vL and vH variable regions in either order, e.g., with respect to the N-terminal and C-terminal ends of the polypeptide, the scFv may comprise vL-linker-vH or may comprise vH-linker-vL. In this disclosure, a scFv is also described as vL-Gly-Ser-Linker-vH. Alternatively, a scFv is also described as (vL+vH) or (vH+vL).

The term "signaling domain" refers to the functional region of a protein which transmits information within the cell to regulate cellular activity via defined signaling pathways by generating second messengers or functioning as effectors by responding to such messengers.

The term "Synthetic Immune Receptor" or alternatively a "SIR" refers to a set of polypeptides, typically two in some embodiments, which when expressed in an effector cell, provides the cell with specificity for a target cell, typically a cancer cell, and with intracellular signal generation. SIRs represent next generation CAR platforms that are described in WO 2018/102795 A1 which is incorporated herein by reference. In a typical embodiment, a SIR comprises one or more antigen binding domains (e.g., antibody or antibody fragment, a ligand or a receptor) that bind to antigens as described herein, and are joined to one or more T cell receptor constant chains or regions via an optional linker. In some embodiments, the set of polypeptides are contiguous with each other. In some embodiments, a SIR comprises two or more sets of two or more polypeptides. The polypeptides of each set of SIR are contiguous with each other (functional polypeptide unit 1) but are not contiguous with the polypeptides of the other set (functional polypeptide unit 2). In some embodiments, the T cell receptor constant chains (or regions) of the SIR is chosen from the constant chain of human T cell receptor-alpha (TCR-alpha or TCRα or TCRα or hTCR-alpha or hTCRα or hTCRα or Cα), human T cell receptor-beta1 (TCR-beta1 or TCRβ1 or TCRb1 or hTCR-beta1 or hTCRβ1 or hTCRb1 or Cβ1), human T cell receptor-beta 2 (TCR-beta2 or TCRβ2 or TCRb2 or hTCR-beta2 or hTCRβ2 or hTCRb2 or Cβ2 also designated TCR-beta, TCRβ or TCRb or Cβ), human Pre-T cell receptor alpha ((preTCR-alpha or preTCRα or preTCRa or preCα), human T cell receptor-gamma (TCR-gamma or TCRγ or TCRg or or hTCR-gamma or hTCRγ or hTCRg or hTCRγ1 or hTCRgamma1, or Cy), or human T cell receptor-delta (TCR-delta or TCRd or TCRδ or hTCR-delta or hTCRd or hTCRδ or Cδ). In some embodiments, the TCR constant chains of SIR are encoded by their wild-type nucleotide sequences while in other aspects the TCR constant chains of SIR are encoded by the nucleotide sequences that are not wild-type. In some embodiments, the TCR constant chains of SIR are encoded by their codon optimized sequences. In some embodiments, the TCR constant chains of SIR encode for the wild-type polypeptide sequences while in other embodiments the TCR constant chains of SIR encoded for polypeptides that carry one or more mutations. In some embodiments, the TCR constant chains of SIR are encoded by their codon optimized sequences that carry one or more mutations. A SIR that comprises an antigen binding domain (e.g., a scFv, or vHH) that targets a specific tumor maker "X", such as those described herein, is also referred to as X-SIR or XSIR. For example, a SIR that comprises an antigen binding domain that targets CD19 is referred to as CD19-SIR or CD19SIR. The TCR constant chain/domain of a SIR can be derived from the same species in which the SIR will ultimately be used. For example, for use in humans, it may be beneficial for the TCR constant chain of the SIR to be derived from or comprised of human TCR constant chains. However, in some instances, it is beneficial for the TCR constant chain to be derived from the same species in which the SIR will ultimately be used in, but modified to carry amino acid substitutions that enhance the expression of the TCR constant chains. For example, for use in humans, it may be beneficial for the TCR constant chain of the SIR to be derived from or comprised of human TCR constant chains but in which certain amino acids are replaced by the corresponding amino acids from the murine TCR constant chains. Such murinized TCR constant chains provide increased expression of the SIR. The SIR or functional portion thereof, can include additional amino acids at the amino or carboxy terminus, or at both termini, which additional amino acids are not found in the amino acid sequence of the TCR or antigen binding domain which make up the SIR. Desirably, the additional amino acids do not interfere with the biological function of the SIR or functional portion, e.g., recognize target cells, detect cancer, treat or prevent cancer, etc. More desirably, the additional amino acids enhance the biological activity, as compared to the biological activity of the parent SIR.

The term "stimulation," refers to a primary response induced by binding of a stimulatory molecule (e.g., a TCR/CD3 complex) with its cognate ligand (or target antigen) thereby mediating a signal transduction event, such as, but not limited to, signal transduction via the TCR/CD3. Stimulation can mediate altered expression of certain molecules.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence includes, but is not limited to, those derived from CD3 zeta, common FeR gamma (FCERIG), Fe gamma RIIa, FeR beta (Fe Epsilon Rib), CD3 gamma, CD3 delta, CD3 epsilon, CD79a, CD79b, DAPIO, and DAP12.

The term "subject" is intended to include living organisms in which an immune response can be elicited (e.g., any domesticated mammals or a human). The terms "subject" or "individual" or "animal" or "patient" are used interchangeably herein to refer to any subject, particularly a mammalian subject, for whom administration of a composition or pharmaceutical composition of the disclosure is desired. Mammalian subjects include humans, non-human primates, dogs, cats, guinea pigs, rabbits, rats, mice, horses, cattle, cows, and the like, with humans being preferred.

"Switch domain," or a "dimerization domain" as used herein, typically refers to a polypeptide-based entity that, in the presence of a dimerization molecule, associates with another switch domain. The association results in a functional coupling of a first entity linked to, e.g., fused to, a first switch domain, and a second entity linked to, e.g., fused to, a second switch domain. A first and second switch domain are collectively referred to as a dimerization switch. In embodiments, the first and second switch domains are the same as one another, e.g., they are polypeptides having the same primary amino acid sequence, and are referred to collectively as a homodimerization switch. In embodiments, the switch is intracellular. In embodiments, the switch domain is a polypeptide-based entity, e.g., FKBP (FK506 binding protein), and the dimerization molecule is small molecule, e.g., AP20187.

The terms "T-cell" and "T-lymphocyte" are interchangeable and used synonymously herein. Examples include but are not limited to naïve T cells ("lymphocyte progenitors"), central memory T cells, effector memory T cells, stem memory T cells ($T_{scm}$), iPSC-derived T cells, synthetic T cells or combinations thereof.

The term "T/NK cell activating antibody therapy" as used herein refers to an antibody therapy that activates the T and/or NK cells. Examples of T/NK cell activating antibody therapy include bispecific T cell engaging antibody (e.g., Blinatumomab) or bispecific NK cell engaging antibody.

The term "TCR-associated signaling module" refers to a molecule having a cytoplasmic immunoreceptor tyrosine-based activation motif (ITAM) that is part of the TCR-CD3 complex. TCR-associated signaling modules include CDγε, CDδε and CD3ζζ.

"Therapeutic agents" as used herein refers to agents that are used to, for example, treat, inhibit, prevent, mitigate the effects of, reduce the severity of, reduce the likelihood of developing, slow the progression of and/or cure, a disease. Diseases targeted by the therapeutic agents include but are not limited to infectious diseases, carcinomas, sarcomas, lymphomas, leukemia, germ cell tumors, blastomas, antigens expressed on various immune cells, and antigens expressed on cells associated with various hematologic diseases, and/or inflammatory diseases.

"Therapeutic Controls" as used herein refers to an element used for controlling the activity of an AMR and/or CAR (including next generation CAR) expressing cell. In some embodiments, therapeutic controls for controlling the activity of the AMR and/or CAR expressing cells of the disclosure comprise any one or more of truncated epidermal growth factor receptor (tEGFR), truncated epidermal growth factor receptor viii (tEGFRviii), truncated CD30 (tCD30), truncated BCMA (tBCMA), truncated CD19 (tCD19), thymidine kinase, cytosine deaminase, nitroreductase, xanthine-guanine phosphoribosyl transferase, human caspase 8, human caspase 9, inducible caspase 9, purine nucleoside phosphorylase, linamarase/linamarin/glucose oxidase, deoxyribonucleoside kinase, horseradish peroxidase (HRP)/indole-3-acetic (IAA), Gamma-glutamylcysteine synthetase, CD20/alphaCD20, CD34/thymidine kinase chimera, dox-dependent caspase-2, mutant thymidine kinase (HSV-TKSR39), AP1903/Fas system, a chimeric cytokine receptor (CCR), a selection marker, and combinations thereof. The SEQ ID NO (DNA): 68 represents a therapeutic control expressing a truncated BCMA and carrying a CD8 signal peptide that can be co-expressed with an AMR, a CAR, a next generation CAR (e.g., a SIR, an Ab-TCR etc) in a cell and can be used to detect, isolated, deplete or purify such genetically modified cells using an antibody (e.g., a monoclonal antibody, an antibody drug conjugate or a bispecific antibody) targeting BCMA. In another embodiment of the disclosure, tBCMA (SEQ ID NO: 68) or a fragment thereof can be expressed in the AMR and/or CAR expressing cells using a single vector or using different vectors. Methods to express two or more genes or modules using single or multiple vectors are known in the art.

The term "therapeutic effect" refers to a biological effect which can be manifested by various means, including but not limited to, e.g., decrease in tumor volume, a decrease in the number of cancer cells, a decrease in the number of metastases, an increase in life expectancy, decrease in cancer cell proliferation, decrease in cancer cell survival, decrease in the titer of the infectious agent, a decrease in colony counts of the infectious agent, amelioration of various physiological symptoms associated with a disease condition. A "therapeutic effect" can also be manifested by the ability of the peptides, polynucleotides, cells and antibodies in prevention of the occurrence of disease in the first place or in the prevention of relapse of the disease.

The term "therapeutically effective amount" as used herein refers to the amount of a pharmaceutical composition comprising one or more peptides as disclosed herein or a mutant, variant, analog or derivative thereof, to decrease at least one or more symptom of the disease or disorder, and relates to a sufficient amount of pharmacological composition to provide the desired effect. The phrase "therapeutically effective amount" as used herein means a sufficient amount of the composition to treat a disorder, at a reasonable benefit/risk ratio applicable to any medical treatment.

A therapeutically or prophylactically significant reduction in a symptom is, e.g. at least about 10%, at least about 20%, at least about 30%, at least about 40%, at least about 50%, at least about 60%, at least about 70%, at least about 80%, at least about 90%, at least about 100%, at least about 125%, at least about 150% or more in a measured parameter as compared to a control or non-treated subject or the state of the subject prior to administering the oligopeptides described herein. Measured or measurable parameters include clinically detectable markers of disease, for example, elevated or depressed levels of a biological marker, as well as parameters related to a clinically accepted scale of symptoms or markers for diabetes. It will be understood, however, that the total daily usage of the compositions and formulations as disclosed herein will be decided by the attending physician within the scope of sound medical judgment. The exact amount required will vary depending on factors such as the type of disease being treated, gender, age, and weight of the subject.

The term "TCR receptor fusion proteins" or "TFP" refers to a next generation CAR platform as described in WO 2016/187349 A1 which is incorporated herein by reference. In an embodiment, a TFP comprises an antibody moiety that specifically binds to a target antigen fused to a TCR chain such as CD3ε, CD3γ, CD3δ, TCRα or TCRβ. Exemplary TCR chains that can be used in the construction of TFP are represented by SEQ ID NOs: 119-122 of this disclosure and are provided in WO 2017/070608 A1 which is incorporated herein by reference. A TFP incorporating CD3ε chain is referred to as a CD3ε TFP or TFPε. A TFP incorporating CD3γ chain is referred to as a CD3γ TFP or TFPγ. A TFP incorporating CD3δ chain is referred to as a CD3δ TFP or TFPδ. The TFP incorporating CD3ε, CD3γ or CD3δ chains are collectively referred to as CD3ε/γ/δ TFP or TFPε/γ/δ.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a poly lysine compound, liposome, and the like. Examples of viral transfer vectors include, but are not limited to, adenoviral vectors, adena-associated virus vectors, retroviral vectors, lentiviral vectors, and the like.

"Transmembrane domain" (TMD) as used herein refers to the region of the AMR or a CAR which crosses the plasma membrane. The transmembrane domain of the AMR or a CAR of the disclosure is the transmembrane region of a transmembrane protein (for example Type I transmembrane proteins), an artificial hydrophobic sequence or a combination thereof. Other transmembrane domains will be apparent to those of skill in the art and may be used in connection with alternate embodiments of the disclosure. In some embodiments, the TMD encoded AMR/CAR comprises a transmembrane domain selected from the transmembrane domain of an alpha, beta or zeta chain of a T-cell receptor, CD3γ, CD3ε, CD3δ, CD28, CD45, CD4, CD5, CD8, CD9, CD16, CD22, CD33, CD37, CD64, CD80, CD86, CD134, CD137, CD154, KIRDS2, OX40, CD2, CD27, LFA-1 (CDlla, CD18), ICOS (CD278), 4-1BB (CD137), GITR, CD40, BAFFR, HVEM (LIGHTR), SLAMF7, NKp80 (KLRFl), CD160, CD19, IL2R beta, IL2R gamma, IL7R a, ITGA1, VLA1, CD49a, ITGA4, IA4, CD49D, ITGA6, VLA-6, CD49f, ITGAD, CDlld, ITGAE, CD103, ITGAL, CDlla, LFA-1, ITGAM, CDllb, ITGAX, CDllc, ITGB1, CD29, ITGB2, CD18, LFA-1, ITGB7, TNFR2, DNAM1(CD226), SLAMF4 (CD244, 2B4), CD84, CD96 (Tactile), CEACAM1, CRT AM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKp44, NKp30, NKp46, NKG2D, and/or NKG2C.

As used herein "Tri-functional T cell antigen coupler" or "Tri-TAC" or "TAC" refer to a next generation CAR platform described in WO 2015/117229 A1, which is incorporated herein by reference. Tri-TAC targeting different antigens can be constructed using the antigen binding domains (e.g., vL and vH fragments, scFv, vHH, ligands and receptors etc.) described in this disclosure using techniques known in the art As used herein, the terms "treat," "treatment," "treating," or "amelioration" refer to therapeutic treatments, wherein the object is to reverse, alleviate, ameliorate, inhibit, slow down or stop the progression or severity of a condition associated with, a disease or disorder. The term "treating" includes reducing or alleviating at least one adverse effect or symptom of a condition, disease or disorder, such as cancer. Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of at least slowing of progress or worsening of symptoms that would be expected in absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, and remission (whether partial or total), whether detectable or undetectable. The term "treatment" of a disease also includes providing relief from the symptoms or side-effects of the disease (including palliative treatment). In some embodiments, treatment of cancer includes decreasing tumor volume, decreasing the number of cancer cells, inhibiting cancer metastases, increasing life expectancy, decreasing cancer cell proliferation, decreasing cancer cell survival, or amelioration of various physiological symptoms associated with the cancerous condition.

"Tumor," as used herein refers to all neoplastic cell growth and proliferation, whether malignant or benign, and all pre-cancerous and cancerous cells and tissues.

"Vector", "cloning vector" and "expression vector" as used herein refer to the vehicle by which a polynucleotide sequence (e.g. a foreign gene) can be introduced into a host cell, so as to transform the host and promote expression (e.g. transcription and translation) of the introduced sequence. Vectors include plasmids, phages, viruses, etc.

The term "viral vector" refers to a vector obtained or derived from a virus. Typically the virus is a retrovirus including, but not limited to, lentiviruses and gamma retroviruses. The viral vector of the disclosure may be a retroviral vector, such as a gamma-retroviral vector. The viral vector may be based on human immunodeficiency virus. The viral vector of the disclosure may be a lentiviral vector. The vector may be based on a non-primate lentivirus such as equine infectious anemia virus (EIAV). The viral vector of the disclosure comprises a mitogenic T-cell activating transmembrane protein and/or a cytokine-based T-cell activating transmembrane protein in the viral envelope. The mitogenic T-cell activating transmembrane protein and/or cytokine-based T-cell activating transmembrane protein is/are derived from the host cell membrane, as explained above.

As used herein "virus like particle" or "VLP" refers to a viral particle lacking a viral genome. In some cases the VLP lacks an env protein. Like with complete viral particles they contain an outer viral envelope made of the host cell lipid-bi-layer (membrane), and hence contain host cell transmembrane proteins. A VLP can be used in the methods and compositions of the disclosure.

The term "zeta" or alternatively "zeta chain", "CD3-zeta" or "TCR-zeta" is defined as the protein provided as GenBan Ace. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain, or functional derivatives thereof, that are sufficient to functionally transmit an initial signal necessary forT cell activation. In one aspect the cytoplasmic domain of zeta comprises residues 52 through 164 of GenBank Ace. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:116 or 117.

The binding domain of an AMR or CAR is selected binds to a desired epitope or antigen. For example, the epitope recognized by a AMR or CAR is determined from the epitope recognized by the scFv used as the binding domain of the AMR or CAR. For example, since the antigen specific domain of the CAR CD8SP-MPL-161-(vL-vH)-BBz (SEQ ID NO: 1596) targeting MPL is comprised of scFv MPL-161-(vL-vH) (SEQ ID NO:346), it is expected that the CAR targets the same epitope as the scFv and/or the parental antibody from which the scFv is derived. The epitope recognized by the scFv MPL-161-(vL-vH) (SEQ ID NO: 346) is provided in SEQ ID NO: 11798. In an exemplary embodiment, an AMR (SEQ ID NO: 1846) comprising the scFv MPL-161-(vL-vH) (SEQ ID NO: 346) as its antigen masking domain can be used to protect stem cells from killing by the CAR CD8SP-MPL-161-(vL-vH)-BBz (SEQ ID NO: 1596). A number of other AMRs targeting MPL are described herein (e.g., SEQ ID NO: 2096 and 3096 etc.) and can be used in the alternate embodiments of the disclosure when used with the corresponding CARs containing MPL-161-(vL-vH) (SEQ ID NO: 346) as their antigen binding domain. The epitopes recognized by several scFv and/or their parental antibodies used in the construction of the CARs and backbones of this disclosure are known in the art. Alternatively, the epitope targeted by an AMR or a CAR can be determined by generating a series of mutants of its target antigen and testing the ability of the mutants to bind to the AMR/CAR-expressing cells using techniques known in the art, for example, using the Topanga Assay. As an example, the epitope recognized by the CAR CD8SP-MPL-161-(vL-vH)-BBz (SEQ ID NO: 1596) targeting MPL can be determined by generating a panel of deletion and point mutants of the MPL-ECD-GGSG-Nluc-AcVS fusion construct (DNA SEQ ID NO: 160 and PRT SEQ ID NO: 6046). The mutant constructs would be transfected into a suitable cell line (e.g., 293FT cells) and the supernatant containing the fusion protein collected and assayed for NLuc activity to assure that the different mutant MPL-ECD-GGSG-Nluc-AcVS fusion proteins are being secreted in the supernatant. Subsequently, the fusion proteins would be tested for their ability to bind to cells (e.g., Jurkat cells or T cells) expressing the CD8SP-MPL-161-(vL-vH)-BBz (SEQ ID NO: 1596) CAR construct. The mutant that fails to bind to the CAR-expressing cells is a candidate for containing the epitope targeted by the MPL-specific CAR. An alternate approach to determine the epitope recognized by a particular CAR could include a functional competitive assay with different test antibodies. For example, T cells expressing the CD8SP-MPL-161-(vL-vH)-BBz (SEQ ID NO: 1596) CAR could be co-cultured with a cell line expressing MPL (e.g., HEL cells) in the absence and presence of increasing concentrations of different test MPL antibodies. In case the epitope recognized by a test MPL antibody overlaps with the epitope recognized by the CD8SP-MPL-161-(vL-vH)-BBz (SEQ ID NO: 1596), then the test antibody would be expected to block target-cell killing and cytokine production induced by T cells expressing the CD8SP-MPL-161-(vL-vH)-BBz (SEQ ID NO: 1596) in a dose-dependent manner. A non-specific antibody of the same isotype as the test antibody would be included as a control and would be expected to have no effect on the target-cell killing and cytokine production induced by T cells expressing the CAR. Similarly, a specific CAR can be expressed in Jurkat-NFAT-EGFP cells and the ability of a test antibody to block EGFP induction by the CAR-expressing Jurkat-NFAT-GFP cells upon coculture with a target cell line can be used to determine whether the epitope recognized by the test antibody overlaps with the epitope recognized by the said CAR.

TABLE 6

| SEQ ID NO OF DIFFERENT COMPONENTS COMPONENTS | | |
|---|---|---|
| Construct component | SEQ ID NO (DNA) | SEQ ID NO (PRT) |
| GMCSF-SP | 14 | 5900 |
| CD8_Signal_Peptide | 15 | 5901 |
| CD8_Signal_Peptide | 16 | 5902 |
| CD8_Signal_Peptide | 17 | 5903 |
| IgH_Signal_Peptide | 18 | 5904 |
| IgH_Signal_Peptide | 19 | 5905 |
| (GGGGS)x3_LINKER | 20 | 5906 |
| (GGSG)7_Linker_2 | 21 | 5907 |
| Myc-(P)-TAG | 22 | 5908 |
| Myc-TAG | 23 | 5909 |
| MYC-TAG | 24 | 5910 |
| MYC2-TAG | 25 | 5911 |
| MYC4-TAG | 26 | 5912 |
| V5-TAG | 27 | 5913 |
| HA-TAG | 28 | 5914 |
| HIS-TAG | 29 | 5915 |
| AVI-TAG-delta-GSG | 30 | 5916 |
| G4Sx2-TAG | 31 | 5917 |
| G4Sx2-TAG | 32 | 5918 |
| StrepTagII | 33 | 5919 |
| StrepTagII | 34 | 5920 |
| FLAG-TAG | 35 | 5921 |
| Qbend10-tag | 36 | 5922 |
| | 37 | 5923 |
| IgCL | 38 | 5924 |
| IgG1-CH1 | 39 | 5925 |
| IgG2-0C CHI | 40 | 5926 |
| IgG2-IC CHI | 41 | 5927 |
| IgG3 CHI | 42 | 5928 |
| IgG4 CHI | 43 | 5929 |
| IgAI CHI | 44 | 5930 |
| IgA2 CHI | 45 | 5931 |
| IgD CHI | 46 | 5932 |
| IgE CHI | 47 | 5933 |
| IgM CHI | 48 | 5934 |
| F2A | 49 | 5935 |
| T2A | 50 | 5936 |
| P2A | 51 | 5937 |
| P2a-variant | 52 | 5938 |
| P2a-variant2-P3A | 53 | 5939 |
| E2A | 54 | 5940 |
| SGSG | 55 | 5941 |
| SGSG | 56 | 5942 |
| FURINE CLEAVAGE SITE | 57 | 5943 |
| | 58 | 5944 |
| CD19 | 59 | 5945 |
| Protein-L | 60 | 5946 |
| Protein-L-2 | 61 | 5947 |
| PuroR_Variant (PAC) | 62 | 5948 |
| BlastR | 63 | 5949 |
| CNB30 | 64 | 5950 |
| GMCSF-SP-tEGFR | 65 | 5951 |
| tEGFRviii | 66 | 5952 |
| tCD19 | 67 | 5953 |
| CD8SP-tBCMA | 68 | 5954 |
| GMCSF-SP-Q-tBCMA | 69 | 5955 |
| CD8SP2-RQRB | 70 | 5956 |
| CD80 | 71 | 5957 |
| PDL-1 | 72 | 5958 |
| PDL-2 | 73 | 5959 |
| FADD-DN | 74 | 5960 |
| K13-vFLIP | 75 | 5961 |
| MC159-vFLIP | 76 | 5962 |
| crmA | 77 | 5963 |
| p35 | 78 | 5964 |
| CD86 | 79 | 5965 |
| hTCR-alpha-constant | 80 | 5966 |
| hTCRa-WT | 81 | 5967 |

TABLE 6-continued

| SEQ ID NO OF DIFFERENT COMPONENTS COMPONENTS | | |
|---|---|---|
| Construct component | SEQ ID NO (DNA) | SEQ ID NO (PRT) |
| hTCRa-CSDVP | 82 | 5968 |
| hTCRa-opt2 | 83 | 5969 |
| hTCRa-T48C-opt | 84 | 5970 |
| hTCRa-T48C-opt1 | 85 | 5971 |
| hTCRa-S61R | 86 | 5972 |
| hTCRa-SDVPR | 87 | 5973 |
| hTCR-b1-constant-region | 88 | 5974 |
| hTCR-b2-constant | 89 | 5975 |
| hTCRb-WT | 90 | 5976 |
| hTCRb-S57C-opt1 | 91 | 5977 |
| hTCRb-KACIAH | 92 | 5978 |
| hTCRb-opt2 | 93 | 5979 |
| hTCRb-R79G | 94 | 5980 |
| hTCR-gamma_M27331.1 | 95 | 5981 |
| hTCRg-(hTCR-gamma) | 96 | 5982 |
| hTCR-(hTCR-delta) | 97 | 5983 |
| hTCRa-CSDVP-R251L | 98 | 5984 |
| hTCRa-opt2-R251L | 99 | 5985 |
| hTCRa-T48C-opt-R251L | 100 | 5986 |
| hTCRa-S61R | 101 | 5987 |
| hTCRa-SDVPR | 102 | 5988 |
| IgG1-CH1-TCRa-SDVP-6MD-R251L | 103 | 5989 |
| IgG1-CH1-TCRa-wt2-opt-6MD-R251L | 104 | 5990 |
| hTCRa-CSDVP-G259L-N261A | 105 | 5991 |
| hTCRa-opt2-G259L-N261A | 106 | 5992 |
| hTCRa-T48C-opt-G259L-N261A | 107 | 5993 |
| hTCRa-S61R-G259L-N261A | 108 | 5994 |
| hTCRa-SDVPR-G259L-N261A | 109 | 5995 |
| IgG1-CH1-TCRa-SDVP-G259L-N261A-6MD | 110 | 5996 |
| IgG1-CH1-TCRa-wt2--G259L-N261A-opt-6MD | 111 | 5997 |
| hCD8-Hinge-TM | 112 | 5998 |
| hCD8-Hinge-TM-BBz | 113 | 5999 |
| hCD8TM-Hinge-BB | 114 | 6000 |
| 4-1BB-cytosolic-domain | 115 | 6001 |
| CD3z-cytosolic-domain | 116 | 6002 |
| CD3z-cytosolic-domain | 117 | 6003 |
| CD28-Hinge-TM-cytosolic-domain | 118 | 6004 |
| CD3d-ECDTMCP-opt2 | 119 | 6005 |
| CD3eECDTMCP-opt2 | 120 | 6006 |
| CD3g-ECDTMCP-opt2 | 121 | 6007 |
| CD3zECDTMCP-opt2 | 122 | 6008 |
| IgCL-TCRg-6MD | 123 | 6009 |
| IgCL-TCRb-IAH-6MD | 124 | 6010 |
| IgCL-TCRb-wt2-opt-6MD | 125 | 6011 |
| IgG1-CH1-TCRd-6MD | 126 | 6012 |
| IgG1-CH1-TCRa-SDVP-6MD | 127 | 6013 |
| IgG1-CH1-TCRa-wt2-opt-6MD | 128 | 6014 |
| IgG1-CD28 spacer | 129 | 6015 |
| IgG1-4-1BB-spacer | 130 | 6016 |
| IgG4-(Hi-CH2-CH3)-spacer | 131 | 6017 |
| IgG4-(Hi-CH3)-spacer | 132 | 6018 |
| IgG4(Hi)-spacer | 133 | 6019 |

TABLE 7

SEQ ID NO OF DIFFERENT ScFV TARGETING DIFFERENT ANTIGENS
scFV Fragments

| Target | NAME | SEQ ID-DNA | SEQ ID-PRT | Target | NAME | SEQ ID-DNA | SEQ ID-PRT |
|---|---|---|---|---|---|---|---|
| CD19 | FMC63 | 205 | 6091 | HIV1-env gp | HIV1-PGT-128 | 330 | 6216 |
| CD19 | huFMC63-11 | 206 | 6092 | HIV1-env gp | HIV1-VR-C01 | 331 | 6217 |
| CD19 | huFMC63-11-N203Q | 207 | 6093 | HIV1-env gp | HIV1-X5 | 332 | 6218 |
| CD19 | CD19Bu12 | 208 | 6094 | HLA-A2 | HLA-A2-3PB2 | 333 | 6219 |
| CD19 | CD19MM | 209 | 6095 | IL11Ra | IL11Ra-8E2-Ts107 | 334 | 6220 |
| CD19 | Ritx-CD19-MOR0028 | 210 | 6096 | IL13Ra2 | IL13Ra2-hu107 | 335 | 6221 |
| CD19 | CD19-hu-mROO5-1 | 211 | 6097 | IL13Ra2 | IL13Ra2-Hu108 | 336 | 6222 |
| AFP/MHC class I | AFP-61 | 212 | 6098 | LAMP1 | LAMP1-humab1-2 | 337 | 6223 |
| AFP/MHC class I | AFP-76 | 213 | 6099 | LAMP1 | LAMP1-Mb4 | 338 | 6224 |
| AFP/MHC class I | AFP-79 | 214 | 6100 | LewisY | LewisY-huS193 | 339 | 6225 |
| HIV1-env gp | HIV1-N6 | 215 | 6101 | L1CAM | L1CAM-9-3-HU3 | 340 | 6226 |
| ALK | Alk-48 | 216 | 6102 | Lym1 | Lym1 | 341 | 6227 |
| ALK | Alk-58 | 217 | 6103 | Lym2 | Lym2 | 342 | 6228 |
| CD45 | BC8-CD45 | 218 | 6104 | CD79b | huMA79bv28 | 343 | 6229 |
| BCMA | BCMA-J6M0 | 219 | 6105 | Mesothelin | Mesothelin-m912 | 344 | 6230 |
| BCMA | BCMA-huC12A3-L3H3 | 220 | 6106 | MPL | MPL-175 | 345 | 6231 |
| BCMA | BCMA-ET-40 | 221 | 6107 | MPL | MPL-161 | 346 | 6232 |
| BCMA | BCMA-ET-54 | 222 | 6108 | MPL | 2-MPL-161-HL | 347 | 6233 |
| BCMA | BCMA-ET-03 | 223 | 6109 | MPL | 2-MPL-111 | 348 | 6234 |
| BCMA | BCMA-huC11.D5.3L1H3 | 224 | 6110 | Muc1/MHC class I | Muc1-D6-M3B8 | 349 | 6235 |
| BCMA | BCMA-huC13-F12 | 225 | 6111 | Muc1/MHC class I | MUC1-D6-M3A1 | 350 | 6236 |
| CCR4 | CCR4-humAb1567 | 226 | 6112 | Muc16 | Muc16-4H11 | 351 | 6237 |
| CD5 | CD5-9 | 227 | 6113 | EGFR | Nimotuzumab | 352 | 6238 |
| CD5 | CD5-18 | 228 | 6114 | NKG2D Ligand | NKG2D-MS | 353 | 6239 |
| CD20 | CD20-2F2 | 229 | 6115 | NY-BR1 | NYBR1 | 354 | 6240 |
| CD20 | CD20-GA101 | 230 | 6116 | PD1 ligand (e.g., PDL1) | PDL1-Atezoli | 355 | 6241 |
| CD20 | CD20-Leu16 | 231 | 6117 | PDL1 | PDL1-SP142 | 356 | 6242 |
| CD20 | CD20-11B8 | 232 | 6118 | PDL1 | PDL1-10A5 | 357 | 6243 |
| CD20 | CD20-2C6 | 233 | 6119 | PSCA | PSCA-Ha14-121 | 358 | 6244 |
| CD20 | CD20-2H7 | 234 | 6120 | PSCA | PSCA-Ha14-117 | 359 | 6245 |
| CD20 | CD20-BM-CA-1925-v4 | 235 | 6121 | PR1/MHC class I | PR1 | 360 | 6246 |
| CD20 | CD20-Ubli-v4 | 236 | 6122 | PSMA | PSMA-006 | 361 | 6247 |
| CD20 | CD20-2H7 | 237 | 6123 | PSMA | PSMA-J591 | 362 | 6248 |
| CD20 | CD20-h1F5 | 238 | 6124 | PTK7 | PTK7-hSC6-23 | 363 | 6249 |
| CD20 | CD20-7D8 | 239 | 6125 | PTK7 | PTK76-10-2 | 364 | 6250 |

TABLE 7-continued

SEQ ID NO OF DIFFERENT ScFV TARGETING DIFFERENT ANTIGENS
scFV Fragments

| Target | NAME | SEQ ID-DNA | SEQ ID-PRT | Target | NAME | SEQ ID-DNA | SEQ ID-PRT |
|---|---|---|---|---|---|---|---|
| CD20 | CD20-AME-33 | 240 | 6126 | SLea | SLea-7E3 | 365 | 6251 |
| CD22 | CD22-h10F4v2 | 241 | 6127 | SLea | SLea-5B1 | 366 | 6252 |
| CD22 | CD22-H22Rhov2ACDRKA | 242 | 6128 | SSEA4 | SSEA4 | 367 | 6253 |
| CD22 | CD22-m971 | 243 | 6129 | TCRB1 | TCRB1-CP01-E09 | 368 | 6254 |
| CD22 | CD22-m971-HL | 244 | 6130 | TCRB1 | TCRB1-Jovil | 369 | 6255 |
| CD30 | CD30-5F11 | 245 | 6131 | TCRB2 | TCRB2-CP01-D05 | 370 | 6256 |
| CD30 | CD30-Ac10 | 246 | 6132 | TCRB2 | TCRB2-CP01-E05 | 371 | 6257 |
| CD32 | CD32-Med9 | 247 | 6133 | TCRgd | TCRgd-G5-4 | 372 | 6258 |
| CD33 | CD33-AF5 | 248 | 6134 | TGFBR2 | TGFBR2-Ab1 | 373 | 6259 |
| CD33 | CD33-huMyc9 | 249 | 6135 | Tissue Factor-1 | TF1-98 | 374 | 6260 |
| CD33 | CD33-Boehr2800308 | 250 | 6136 | TIM1/HAVCR | TIM1-HVCR1-270-2 | 375 | 6261 |
| CD33 | CD33-Him3-4 | 251 | 6137 | TIM1/HAVCR | TIM1-HVCR1-ARD5 | 376 | 6262 |
| CD33 | CD33-SGNh2H12 | 252 | 6138 | TnAg | TnAg | 377 | 6263 |
| CD33 | CD33-15G15-33 | 253 | 6139 | Tn-Muc1 | TnMuc1-hu5E5-RHA8-RKA-2 | 378 | 6264 |
| CD33 | CD33-33H4 | 254 | 6140 | TROP2 | TROP2-ARA47-HV3KV3 | 379 | 6265 |
| CD33 | CD33-9C3-2 | 255 | 6141 | TROP2 | TROP2-h7E6-SVG | 380 | 6266 |
| CD34 | CD34-hu4C7 | 256 | 6142 | TSHR | TSHR-K1-70 | 381 | 6267 |
| CD44v6 | CD44v6-Biwa8 | 257 | 6143 | TSHR | TSHR-KB1 | 382 | 6268 |
| CD70 | CD70-h1F6 | 258 | 6144 | TSHR | TSHR-5C9 | 383 | 6269 |
| CD79b | CD79b-2F2 | 259 | 6145 | TSLPR | TSLPR | 384 | 6270 |
| CD79b | huMA79bv28 | 260 | 6146 | VEGFR3 | VEGFR3-Ab1 | 385 | 6271 |
| CD99 | CD99-hu12E7 | 261 | 6147 | WT1/MHC class I | WT1-Ab5 | 386 | 6272 |
| CD123 | CD123-CSL362 | 262 | 6148 | WT1/MHC class I | WT1-Ab13 | 387 | 6273 |
| CD123 | CD123-1172 | 263 | 6149 | WT1/MHC class I | WT1-Ab15 | 388 | 6274 |
| CD123 | CD123-DART-1 | 264 | 6150 | CDH19 | CDH19-4B10 | 389 | 6275 |
| CD123 | CD123-DART-2 | 265 | 6151 | Folate Receptor beta | FRbeta-m923 | 390 | 6276 |
| CD123 | CD123-I3RB18 | 266 | 6152 | LHR | LHR-8B7 | 391 | 6277 |
| CD123 | CD123-hu3E3 | 267 | 6153 | LHR | LHR-5F4-21 | 392 | 6278 |
| CD123 | CD123-9F6 | 268 | 6154 | B7H4 | B7H4-hu22C10 | 393 | 6279 |
| CD123 | CD123-I3RB2 | 269 | 6155 | B7H4 | B7H4-hu1D11 | 394 | 6280 |
| CD123 | CD123-1176 | 270 | 6156 | CD23 | CD23-p5E8 | 395 | 6281 |
| CD123 | Ritx2-CD123-8B11 | 271 | 6157 | GCC | GCC-5F9 | 396 | 6282 |
| CD123 | CD123-2B8 | 272 | 6158 | GCC | GCC-Ab229 | 397 | 6283 |
| CD123 | CD123-9D7 | 273 | 6159 | CD200R | CD200R-huDx182 | 398 | 6284 |

TABLE 7-continued

| SEQ ID NO OF DIFFERENT ScFV TARGETING DIFFERENT ANTIGENS scFV Fragments | | | | | | | |
|---|---|---|---|---|---|---|---|
| Target | NAME | SEQ ID-DNA | SEQ ID-PRT | Target | NAME | SEQ ID-DNA | SEQ ID-PRT |
| CD123 | CD123-3B10 | 274 | 6160 | CD123 | CD123-1172 | 399 | 6285 |
| CD138 | CD138 | 275 | 6161 | BCMA | BCMA-AJ | 400 | 6286 |
| CD179b | CD179b | 276 | 6162 | BCMA | BCMA-BB-CAR02 | 401 | 6287 |
| CD276 | CD276-17 | 277 | 6163 | BCMA | BCMA-FS | 402 | 6288 |
| CD324 | CD32410-6 | 278 | 6164 | BCMA | BCMA-NM | 403 | 6289 |
| CD324 | CD324-hSC10-17 | 279 | 6165 | BCMA | BCMA-PC | 404 | 6290 |
| CDH6 | CDH6-NOV710 | 280 | 6166 | BCMA | BCMA-PP | 405 | 6291 |
| CDH6 | CDH6-NOV712 | 281 | 6167 | BCMA | BCMA-RD | 406 | 6292 |
| CDH17 | CDH17-PTA001A4 | 282 | 6168 | BCMA | BCMA-TS | 407 | 6293 |
| CDH19 | CDH19-16A4 | 283 | 6169 | BST1 | hu-BST1-A1 | 408 | 6294 |
| EGFR | Cetuximab | 284 | 6170 | BST1 | hu-BST1-A2 | 409 | 6295 |
| CLEC5A | CLEC5A-8H8F5 | 285 | 6171 | BST1 | hu-BST1-A3 | 410 | 6296 |
| CLEC5A | CLEC5A-3E12A2 | 286 | 6172 | CD19 | hu-Bu13 | 411 | 6297 |
| CLL1 | CLL1-M26 | 287 | 6173 | CD22 | CD22-HA22 | 412 | 6298 |
| CLL1 | CLL1-M32 | 288 | 6174 | CLL1 | CLL1-24C1 | 413 | 6299 |
| CLL1 | CLL1-21C9-L2H3 | 289 | 6175 | CLL1 | CLL1-24C8 | 414 | 6300 |
| CLL1 | CLL1-6E7L4H1e | 290 | 6176 | Cripto | hu-Cripto-L1H2 | 415 | 6301 |
| CLL1 | CLL1-hu1075-v1 | 291 | 6177 | FLT3 | FLT3-8B5 | 416 | 6302 |
| CLL1 | CLL1-hu1075-v2 | 292 | 6178 | FLT3 | FLT3-8B5 | 417 | 6303 |
| CS1 (SLAMF7) | CS1-huLuc63 | 293 | 6179 | FLT3 | FLT3-10E3 | 418 | 6304 |
| CS1 (SLAMF7) | CS1-HuLuc64 | 294 | 6180 | FLT3 | FLT3-10E3 | 419 | 6305 |
| CS1 (SLAMF7) | CS1-Luc90 | 295 | 6181 | gpA33 | hu-gpA33 | 420 | 6306 |
| CS1 (SLAMF7) | CS1-PDL241 | 296 | 6182 | gpA33 | hu-gpA33 | 421 | 6307 |
| CS1 (SLAMF7) | CS1-Hu27A | 297 | 6183 | Her2 | Her2-XMT-1517-vL4 | 422 | 6308 |
| CS1 (SLAMF7) | CS1Hu34C3 | 298 | 6184 | Her2 | Her2-XMT-1517-vL4 | 423 | 6309 |
| CS1 (SLAMF7) | CS1-Hu31-D2 | 299 | 6185 | Her2 | Her2-XMT-1519-vL4 | 424 | 6310 |
| CS1 (SLAMF7) | CS1-Luc34 | 300 | 6186 | Her2 | Her2-XMT-1519-vL4 | 425 | 6311 |
| CS1 (SLAMF7) | CS1-LucX2 | 301 | 6187 | IL1RAP | IL1RAP-IAPB57 | 426 | 6312 |
| CSF2RA | CSF2RA-Ab6 | 302 | 6188 | IL1RAP | IL1RAP-IAPB57 | 427 | 6313 |
| CSF2RA | CSF2RA-Ab1 | 303 | 6189 | IL1RAP | IL1RAP-IAPB63 | 428 | 6314 |
| DLL3 | DLL3-hSC16-13 | 304 | 6190 | IL1RAP | IL1RAP-IAPB63 | 429 | 6315 |
| DLL3 | DLL3-hSC16-56 | 305 | 6191 | IL1RAP | hu-IL1RAP-CANO4 | 430 | 6316 |
| EGFRvIII | EGFRvIII-139 | 306 | 6192 | IL1RAP | hu-IL1RAP-CANO4 | 431 | 6317 |
| EGFRvIII | EGFRvII1-2173 | 307 | 6193 | Liv1 | hLiv1-mAb2 | 432 | 6318 |
| EpCam1 | Epcam1-MM1 | 308 | 6194 | Liv1 | hLiv1-mAb2 | 433 | 6319 |
| EpCam1 | Epcam1-D5K5 | 309 | 6195 | MSLN | MSLN-7D9-v3 | 434 | 6320 |
| FLT3 | FLT3-NC7 | 310 | 6196 | MSLN | MSLN-7D9-v3 | 435 | 6321 |
| FITC | FITC | 311 | 6197 | MSLN | MSLN-hu22A10 | 436 | 6322 |

TABLE 7-continued

SEQ ID NO OF DIFFERENT ScFV TARGETING DIFFERENT ANTIGENS
scFV Fragments

| Target | NAME | SEQ ID-DNA | SEQ ID-PRT | Target | NAME | SEQ ID-DNA | SEQ ID-PRT |
|---|---|---|---|---|---|---|---|
| FITC | FITC-4M-53 | 312 | 6198 | MSLN | MSLN-hu22A10 | 437 | 6323 |
| FITC | FITC-E2-HL | 313 | 6199 | Nectin | hu-Nectin4-mAb1 | 438 | 6324 |
| FR1 (Folate Receptor alpha) | FR1-huMov19 | 314 | 6200 | Nectin | hu-Nectin4-mAb1 | 439 | 6325 |
| GD2 | GD2-hu14-18 | 315 | 6201 | ROR1 | ROR1-DART4 | 440 | 6326 |
| GD2 | GD2-hu3F8 | 316 | 6202 | ROR1 | ROR1-DART4 | 441 | 6327 |
| GD3 | GD3-KM-641 | 317 | 6203 | STEAP1 | STEAP1-hu120 | 442 | 6328 |
| GFRa4 | GFRAlpha4-P4-6 | 318 | 6204 | STEAP1 | STEAP1-hu120 | 443 | 6329 |
| GFRa4 | GFRa4-P4-10 | 319 | 6205 | CD52 | CD52-2E8 | 444 | 6330 |
| GM1 | GM1-5B2 | 320 | 6206 | TCRa | TCRa-CIV5 | 445 | 6331 |
| GM1 | GM1-7E5 | 321 | 6207 | CD3 | CD3e-38E4V2 | 446 | 6332 |
| GPRC5D | GPRC5D-ET150-5 | 322 | 6208 | CCR5 | CCR5-PRO140 | 447 | 6333 |
| GPRC5D | GPRC5D-ET150-18 | 323 | 6209 | CXCR4 | CXCR4-515H7 | 448 | 6334 |
| GPRC5D | GPRC5D-ET150-1 | 324 | 6210 | CD4 | CD4-MV1 | 449 | 6335 |
| GPRC5D | GPRC5D-ET150-2 | 325 | 6211 | CD3 | CD3e-hu-UCTH1 | 450 | 6336 |
| GPC3 | GPC3-4E5 | 326 | 6212 | NKp46 | NKp46-1 | 451 | 6337 |
| gpNMB | gpNMB-115 | 327 | 6213 | TCRab | TCRab-BMA031-1 | 452 | 6338 |
| HIV1-gag | HIV1-E5 | 328 | 6214 | B2M | B2M-1 | 453 | 6339 |
| HIV1-env gp | HIV1-3BNC117 | 329 | 6215 | PD1 | PD1-947 | 11820 | 11865 |
| PD1 | Hu-PD1-947 | 11835 | 11880 | PD1 | PD1-17 | 11850 | 11895 |

TABLE 8

GUIDE TO SEQUENCE IDENTIFICATION OF DIFFERENT CONSTRUCTS WITH SEQUENCE ID OF DIFFERENT scFV SHOWN IN TABLE 7 SERVING AS REFERENCE

| CONSTRUCT ARCHITECTURE | EXEMPLARY CONSTRUCT | SEQ ID NO DNA | SEQ ID NO PRT |
|---|---|---|---|
| ScFv | FMC63-(vL-vH) | 205-453, 11820, 11835, 11850 | 6091-6339, 11865,11880, 11895 |
| scFv-KDE | FMC63-(vL-vH)-KDEL | 455-703, 11821, 11836, 11851 | 6341-6589, 11866, 11881, 11896 |
| scFv-His | FMC63-(vL-vH)-His | 705-953, 11822, 11837, 11852 | 6591-6839, 11867, 11882, 11897 |
| scFv-dTAG-KDEL | FMC63-(vL-vH)-dTAG-KDEL | 955-1203, 11823, 11838, 11853 | 6841-7089, 11868, 11883, 11898 |
| scFv-ShieldTag-KDEL | FMC63-(vL-vH)-ShieldTAG-KDEL | 1205-1453, 11824, 11839, 11854 | 7091-7339, 11869, 11884, 11899 |
| 2nd Generation BBz CAR | CD8SP-FMC63-(vL-vH)-BBz | 1455-1703, 11825, 11840, 11855 | 7341-7589, 11870, 11885, 11900 |
| AMR with CD8 hinge and Transmembrane domain | CD8SP-FMC63-(vL-vH)-CD8TM-BB-L4 | 1705-1953, 11826, 11841, 11856 | 7591-7839, 11871, 11886, 11901 |

TABLE 8-continued

| GUIDE TO SEQUENCE IDENTIFICATION OF DIFFERENT CONSTRUCTS WITH SEQUENCE ID OF DIFFERENT scFV SHOWN IN TABLE 7 SERVING AS REFERENCE | | | |
|---|---|---|---|
| CONSTRUCT ARCHITECTURE | EXEMPLARY CONSTRUCT | SEQ ID NO DNA | SEQ ID NO PRT |
| AMR with CD24-GPI linker | CD8SP-FMC63-(vL-vH)-CD8-Hinge-CD24-GPI | 1955-2203, 11827, 11842, 11857 | 7841-8089, 11872, 11887, 11902 |
| AMR with CD8 hinge and Transmembrane domain and dTAG | CD8SP-FMC63-(vL-vH)-CD8TM-BB-L4-dTAG | 2205-2453, 11828, 11843, 11858 | 8091-8339, 11873, 11888, 11903 |
| AMR with CD8 hinge and Transmembrane domain and ShieldTAG | CD8SP-FMC63-(vL-vH)-CD8TM-BB-L4-ShildTAG | 2455-2703, 11829, 11844, 11859 | 8341-8589, 11874, 11889, 11904 |
| AMR with CD28 hinge and Transmembrane domain | CD8SP-FMC63-(vL-vH)-CD28TM-CP-L2 | 2705-2953, 11830, 11845, 11860 | 8591-8839, 11875, 11890, 11905 |
| AMR with CD28 hinge and Transmembrane domain and dTAG | CD8SP-FMC63-(vL-vH)-CD28TM-CP-L2-dTAG | 2955-3203, 11831, 11846, 11861 | 8841-9089, 11876, 11891, 11906 |
| AMR with CD28 hinge and Transmembrane domain and ShieldTAG | CD8SP-FMC63-(vL-vH)-CD28TM-CP-L2-ShieldTAG | 3205-3453, 11832, 11847, 11862 | 9091-9339, 11877, 11892, 11907 |

TABLE 9

| EXEMPLARY RECEPTOR EXTRACELLULAR DOMAINS | | | |
|---|---|---|---|
| Antigen | Exemplary Receptor Extracellular Domains Name of Receptor ECD | SEQ ID NO (DNA) | SEQ ID NO (PRT) |
| CD19 | CD19-Extracellular-Domain-minus-signal-peptide(61-867) | 135 | 6021 |
| MPL | MPL-Extracellular-Domain with signal peptide | 136 | 6022 |
| PD1 | CD8-SP-PD1-opt-ECD | 137 | 6023 |
| PD1 | PD1-opt-ECD minus signal peptide | 138 | 6024 |
| PD1 | PD1-ECD-with-native-Signal-Peptide | 139 | 6025 |
| CTLA4 | CTLA4-opt-ECD with signal peptide | 140 | 6026 |
| CD138 | CD138-SDC1-ECD-with signal peptide | 141 | 6027 |
| CD123 | Synth-CD123-ECD-with-signal-peptide | 142 | 6028 |
| CDH1 | CDH1-ECD-with signal peptide | 143 | 6029 |
| CD200R | CD200R1L-ECD-with signal peptide | 144 | 6030 |
| GPNMB | GPNMB-ECD-with signal peptide | 145 | 6031 |
| PTK7 | PTK7-ECD | 146 | 6032 |
| CD33 | CD33-ECD-with-signal-peptide | 147 | 6033 |
| CD34 | CD34-ECD | 148 | 6034 |
| EpCAM | EpCAM-ECD-with signal peptide | 149 | 6035 |
| CLEC12A | CLEC12A-ECD | 150 | 6036 |
| CD20 | CD20-ECx2-ECD-with-signal peptide | 151 | 6037 |
| CD20 | CD20-ECx1-ECD-with signal-peptide | 152 | 6038 |
| CD20 | CD22v5-ECD-with-signal-peptide | 153 | 6039 |
| TSHR | TSHR-ECD-with signal peptide | 154 | 6040 |
| EGFRvIII | EGFRviii-ECD-with signal peptide | 155 | 6041 |
| BCMA | BCMA-ECD-without signal peptide | 156 | 6042 |
| SLAMF7/CS1 | SLAMF7-CS1-ECD-with signal peptide | 157 | 6043 |
| NKG2D | NKG2D-ECD-minus-signal-peptide | 158 | 6044 |

TABLE 10

Exemplary Receptor Extracellular Domains-Luc Fusion proteins
Exemplary Receptor Extracellular Domains-Luc Fusion proteins

| Antigen | Name of Receptor Extracellular domain Luc Fusion | SEQ ID NO (DNA) | SEQ ID NO (PRT) |
|---|---|---|---|
| MPL | MPL-ECD-GGSG-Nluc-AcV5 | 160 | 6046 |
| CD19 | FLAG-CD19-ECD-GGSG-NLuc-AcV5 | 161 | 6047 |
| CD19 | CD19-ECD-GGSG-NLuc-4xFlag-2xStreptag-8xHis-T2A-Pac | 162 | 6048 |
| CD19 | FLAG-CD19-ECD-GGS-Turboluc16-4xFlag-2xStreptag-8xHis-T2A-Pac | 163 | 6049 |
| CD33 | CD33-ECD-GGSG-NLuc-4xFlag-2xStreptag-8xHis-T2A-Pac | 164 | 6050 |
| CD33 | CD33-ECD-GGSG-Turboluc16-4xFlag-2xStreptag-8xHis-T2A-Pac | 165 | 6051 |
| CD138 | CD138-SDC1-ECD-GGSG-NLuc-4xFlag-2xStreptag-8xHis-T2A-Pac | 166 | 6052 |
| CD123 | Synth-CD123-ECD-GGSG-NLuc-4xFlag-2xStreptag-8xHis-T2A-Pac | 167 | 6053 |
| CDH1 | CDH1-ECD-GGSG-NLuc-4xFlag-2xStreptag-8xHis-T2A-Pac | 168 | 6054 |
| CD200R | CD200R-ECD-GGSG-NLuc-4xFlag-2xStreptag-8xHis-T2A-Pac | 169 | 6055 |
| GPNMB | GPNMB-ECD-GGSG-NLuc-4xFlag-2xStreptag-8xHis-T2A-Pac | 170 | 6056 |
| PTK7 | PTK7-ECD-GGSG-NLuc-4xFlag-2xStreptag-8xHis-T2A-Pac | 171 | 6057 |
| CD34 | CD34-ECD-GGSG-NLuc-4xFlag-2xStreptag-8xHis-T2A-Pac | 172 | 6058 |
| EpCAM | EpCAM-ECD-GGSG-NLuc-4xFlag-2xStreptag-8xHis-T2A-Pac | 173 | 6059 |
| CLEC12A | CLEC12A-ECD-GGSG-NLuc-4xFlag-2xStreptag-8xHis-T2A-Pac | 174 | 6060 |
| CD20 | CD20-ECx2-ECD-GGSG-TurboLuc16-4xFlag-2xStreptag-8xHis-T2A-Pac | 175 | 6061 |
| CD20 | CD20-ECx1-ECD-GGSG-TurboLuc16-4xFlag-2xStreptag-8xHis-T2A-Pac | 176 | 6062 |
| CD22 | hCD22v5-ECD-GGSG-NLuc-4xFlag-2xStreptag-8xHis-T2A-Pac | 177 | 6063 |
| TSHR | TSHR-ECD-GGSG-NLuc-4xFlag-2xStreptag-8xHis-T2A-Pac | 178 | 6064 |
| EGFRviii | EGFRviii-ECD-GGSG-NLuc-4xFlag-2xStreptag-8xHis-T2A-Pac | 179 | 6065 |
| BCMA | CD8SP-BCMA-ECD-GGSG-NLuc-4xFlag-2xStreptag-8xHis-T2A-Pac | 180 | 6066 |
| SLAMF7 | SLAMF7-CS1-ECD-GGSG-NLuc-4xFlag-2xStreptag-8xHis-T2A-Pac | 181 | 6067 |
| PD1 | PD1-ECD-GGSG-NLuc-4xFlag-2xStreptag-8xHis-T2A-Pac | 182 | 6068 |
| CTLA4 | CTLA4-opt-ECD-NLuc-4xFLAG-x2STREP-8xHis-T2A-PAC | 183 | 6069 |
| NKGD2 | CD8SP-NKG2D-ECD-4xFLAG-x2STREP-8xHis-T2A-PAC | 184 | 6070 |
| ProteinL | CD8SP-ProteinL-GGSG-NLuc-4xFLAG-x2STREP-8xHis-T2A-PAC | 185 | 6071 |
| ProteinL | CD8SP-ProteinL-GGSG-NLuc-4xFLAG-x2STREP-8xHis-T2A-PAC | 186 | 6072 |

TABLE 11

Exemplary scFv-Luc Fusion proteins
Exemplary scFv-Luc Fusion proteins

| Antigen | Name of Receptor ECD | SEQ ID NO (DNA) | SEQ ID NO (PRT) |
|---|---|---|---|
| CD19 | CD8SP-FMC63-(vL-vH)-GGSG-NLuc-4xFLAG-x2STREP-8xHis-T2A-PAC | 188 | 6074 |
| CD19 | CD8SP-CD19Bu12-(vL-vH)-GGSG-NLuc-4xFLAG-x2STREP-8xHis-T2A-PAC | 189 | 6075 |
| CD19 | CD8SP-CD19-hu-mROO5-1-(vL-vH)-GGSG-NLuc-4xFLAG-x2STREP-8xHis-T2A-PAC | 190 | 6076 |

TABLE 11-continued

Exemplary scFv-Luc Fusion proteins
Exemplary scFv-Luc Fusion proteins

| Antigen | Name of Receptor ECD | SEQ ID NO (DNA) | SEQ ID NO (PRT) |
|---|---|---|---|
| BCMA | CD8SP-BCMA-J6M0-(vL-vH)-GGSG-NLuc-4xFLAG-x2STREP-8xHis-T2A-PAC | 191 | 6077 |
| BCMA | CD8SP-BCMA-huC12A3-L3H3-(vL-vH)-GGSG-NLuc-4xFLAG-x2STREP-8xHis-T2A-PAC | 192 | 6078 |
| CD20 | CD8SP-CD20-2F2-(vL-vH)-GGSG-NLuc-4xFLAG-x2STREP-8xHis-T2A-PAC | 193 | 6079 |
| CD20 | CD8SP-CD20-GA101-(vL-vH)-GGSG-NLuc-4xFLAG-x2STREP-8xHis-T2A-PAC | 194 | 6080 |
| CD22 | CD8SP-CD22-h10F4v2-(vL-vH)-GGSG-NLuc-4xFLAG-x2STREP-8xHis-T2A-PAC | 195 | 6081 |
| CD33 | CD8SP-CD33-AF5-(vL-vH)-GGSG-NLuc-4xFLAG-x2STREP-8xHis-T2A-PAC | 196 | 6082 |
| CD33 | CD8SP-CD33-huMyc9-(vL-vH)-GGSG-NLuc-4xFLAG-x2STREP-8xHis-T2A-PAC | 197 | 6083 |
| CD123 | CD8SP-CD123-1172-(vL-vH)-GGSG-NLuc-4xFLAG-x2STREP-8xHis-T2A-PAC | 198 | 6084 |
| CD123 | CD8SP-CD123-DART-1-(vL-vH)-GGSG-NLuc-4xFLAG-x2STREP-8xHis-T2A-PAC | 199 | 6085 |
| CS1 | CD8SP-CS1-HuLuc64-(vL-vH)-GGSG-NLuc-4xFLAG-x2STREP-8xHis-T2A-PAC | 200 | 6086 |
| CS1 | CD8SP-CS1-Luc90-(vL-vH)-GGSG-NLuc-4xFLAG-x2STREP-8xHis-T2A-PAC | 201 | 6087 |
| MPL | CD8SP-MPL-161-(vL-vH)-GGSG-NLuc-4xFLAG-x2STREP-8xHis-T2A-PAC | 202 | 6088 |
| MPL | CD8SP-MPL-161-HL-(vH-vL)-GGSG-NLuc-4xFLAG-x2STREP-8xHis-T2A-PAC | 203 | 6089 |

TABLE 12

MHC I (HLA-A2) restricted peptides used for generation of CARs

| Protein/Epitope | SEQ ID NO: | Protein/Epitope | SEQ ID NO: |
|---|---|---|---|
| gp100 | 10511 | MART (26-35) | 10521 |
| gp100 | 10512 | EBNA-3A (596-604) | 10522 |
| gp100 | 10513 | EBNA-3c | 10523 |
| MUC1-A7 (130-138) | 10514 | WT1 | 10524 |
| MUC1-D6 (13-21) | 10515 | PR1 | 10525 |
| TAX (11-19) | 10516 | Ras9-G12V | 10526 |
| hTERT(540-548) | 10517 | HPV16-E7 | 10527 |
| hTERT (865-873) | 10518 | NY-ESO-1-(155-163) | 10528 |
| HIV1 gag (77-85) | 10519 | NY-ESO-1-(157-165) | 10529 |
| CMV-pp65(495-503) | 10520 | NY-ESO-1-(157-167) | 10530 |

TABLE 13

EXEMPLARY SIRs WITH hTCRa-T48C-R251L-opt CHAIN

| Target | Name of CAR constructs including the name of antigen binding domain | SEQ ID NO (DNA) | SEQ ID NO (PRT) |
|---|---|---|---|
| CD19 | CD8SP-FMC63-[hTCRb-S57C-opt]-F-P2A-SP-FMC63-vH-[hTCRa-T48C-R251L-opt] | 3461 | 9347 |
| CD19 | CD8SP-huFMC63-11-vL-[hTCRb-S57C-opt]-F-P2A-SP-huFMC63-11-vH-[hTCRa-T48C-R251L-opt] | 3462 | 9348 |
| CD19 | CD8SP-CD19Bu12-vL-[hTCRb-S57C-opt]-F-P2A-SP-CD19Bu12-vH-[hTCRa-T48C-R251L-opt] | 3463 | 9349 |
| CD19 | CD8SP2-CD19MM-vL-[hTCRb-S57C-opt]-F-P2A-SP-CD19MM-vH-[hTCRa-T48C-R251L-opt] | 3464 | 9350 |
| CD19 | CD8SP-CD19-4G7-vL-[hTCRb-S57C-opt]-F-P2A-SP-CD19-4G7-vH-[hTCRa-T48C-R251L-opt] | 3465 | 9351 |
| HIV1-env | CD8SP-HIV1-N6-vL-[hTCRb-S57C-opt]-F-P2A-SP-HIV1-N6-vH-[hTCRa-T48C-R251L-opt] | 3466 | 9352 |
| ALK | CD8SP-Alk-48-vL-[hTCRb-S57C-opt]-F-P2A-SP-Alk-48-vH-[hTCRa-T48C-R251L-opt] | 3467 | 9353 |
| ALK | CD8SP-Alk-58-vL-[hTCRb-S57C-opt]-F-P2A-SP-Alk-58-vH-[hTCRa-T48C-R251L-opt] | 3468 | 9354 |
| CD45 | CD8SP-BC8-CD45-vL-[hTCRb-S57C-opt]-F-P2A-SP-BC8-CD45-vH-[hTCRa-T48C-R251L-opt] | 3469 | 9355 |
| BCMA | CD8SP-BCMA-J6M0-vL-[hTCRb-S57C-opt]-F-P2A-SP-BCMA-J6M0-vH-[hTCRa-T48C-R251L-opt] | 3470 | 9356 |
| BCMA | CD8SP-BCMA-huC12A3-L3H3-vL-[hTCRb-S57C-opt]-F-P2A-SP-BCMA-huC12A3-L3H3-vH-[hTCRa-T48C-R251L-opt] | 3471 | 9357 |
| BCMA | CD8SP-BCMA-ET-40-vL-[hTCRb-S57C-opt]-F-P2A-SP-BCMA-ET-40-vH-[hTCRa-T48C-R251L-opt] | 3472 | 9358 |
| BCMA | CD8SP-BCMA-ET-54-vL-[hTCRb-S57C-opt]-F-P2A-SP-BCMA-ET-54-vH-[hTCRa-T48C-R251L-opt] | 3473 | 9359 |
| CCR4 | CD8SP-CCR4-humAb1567-vL-[hTCRb-S57C-opt]-F-P2A-SP-CCR4-humAb1567-vH-[hTCRa-T48C-R251L-opt] | 3474 | 9360 |
| HIV1-env | CD8SP-CD4-ECD-[hTCRb-S57C-opt]-F-P2A-SP-DC-SIGN-[hTCRa-T48C-R251L-opt] | 3475 | 9361 |
| CD5 | CD8SP-CD5-9-vL-[hTCRb-S57C-opt]-F-P2A-SP-CD5-9-vH-[hTCRa-T48C-R251L-opt] | 3476 | 9362 |
| CD5 | CD8SP-CD5-18-vL-[hTCRb-S57C-opt]-F-P2A-SP-CD5-18-vH-[hTCRa-T48C-R251L-opt] | 3477 | 9363 |
| CD20 | CD8SP-CD20-2F2-vL-[hTCRb-S57C-opt]-F-P2A-SP-CD20-2F2-vH-[hTCRa-T48C-R251L-opt] | 3478 | 9364 |
| CD20 | CD8SP-CD20-GA101-vL-[hTCRb-S57C-opt]-F-P2A-SP-CD20-GA101-vH-[hTCRa-T48C-R251L-opt] | 3479 | 9365 |
| CD22 | CD8SP-CD22-h10F4v2-vL-[hTCRb-S57C-opt]-F-P2A-SP-CD22-h10F4v2-vH-[hTCRa-T48C-R251L-opt] | 3480 | 9366 |
| CD22 | CD8SP-CD22-H22Rhov2ACDRKA-vL-[hTCRb-S57C-opt]-F-P2A-SP-CD22-H22Rhov2ACDRKA-vH-[hTCRa-T48C-R251L-opt] | 3481 | 9367 |

TABLE 13-continued

EXEMPLARY SIRs WITH hTCRa-T48C-R251L-opt CHAIN

| Target | Name of CAR constructs including the name of antigen binding domain | SEQ ID NO (DNA) | SEQ ID NO (PRT) |
|---|---|---|---|
| CD22 | CD8SP-CD22-m971-vL-[hTCRb-S57C-opt]-F-P2A-SP-CD22-m971-vH-[hTCRa-T48C-R251L-opt] | 3482 | 9368 |
| CD30 | CD8SP-CD30-5F11-vL-[hTCRb-S57C-opt]-F-P2A-SP-CD30-5F11-vH-[hTCRa-T48C-R251L-opt] | 3483 | 9369 |
| CD30 | CD8SP-CD30-Ac10-vL-[hTCRb-S57C-opt]-F-P2A-SP-CD30-Ac10-vH-[hTCRa-T48C-R251L-opt] | 3484 | 9370 |
| CD32 | CD8SP-CD32-Med9-vL-[hTCRb-S57C-opt]-F-P2A-SP-CD32-Med9-vH-[hTCRa-T48C-R251L-opt] | 3485 | 9371 |
| CD33 | CD8SP-CD33-AF5-vL-[hTCRb-S57C-opt]-F-P2A-SP-CD33-AF5-vH-[hTCRa-T48C-R251L-opt] | 3486 | 9372 |
| CD33 | CD8SP-CD33-huMyc9-vL-[hTCRb-S57C-opt]-F-P2A-SP-CD33-huMyc9-vH-[hTCRa-T48C-R251L-opt] | 3487 | 9373 |
| CD34 | CD8SP-CD34-hu4C7-vL-[hTCRb-S57C-opt]-F-P2A-SP-CD34-hu4C7-vH-[hTCRa-T48C-R251L-opt] | 3488 | 9374 |
| CD44v6 | CD8SP-CD44v6-Biwa8-vL-[hTCRb-S57C-opt]-F-P2A-SP-CD44v6-Biwa8-vH-[hTCRa-T48C-R251L-opt] | 3489 | 9375 |
| CD70 | CD8SP-CD70-h1F6-vL-[hTCRb-S57C-opt]-F-P2A-SP-CD70-h1F6-vH-[hTCRa-T48C-R251L-opt] | 3490 | 9376 |
| CD79b | CD8SP-CD79b-2F2-vL-[hTCRb-S57C-opt]-F-P2A-SP-CD79b-2F2-vH-[hTCRa-T48C-R251L-opt] | 3491 | 9377 |
| CD123 | CD8SP-CD123-CSL362-vL-[hTCRb-S57C-opt]-F-P2A-SP-CD123-CSL362-vH-[hTCRa-T48C-R251L-opt] | 3492 | 9378 |
| CD138 | CD8SP-CD138-[hTCRb-S57C-opt]-F-P2A-SP-CD138-vH-[hTCRa-T48C-R251L-opt] | 3493 | 9379 |
| CD179b | CD8SP-CD179b-vL-[hTCRb-S57C-opt]-F-P2A-SP-CD179b-vH-[hTCRa-T48C-R251L-opt] | 3494 | 9380 |
| CD276 | CD8SP-CD276-17-vL-[hTCRb-S57C-opt]-F-P2A-SP-CD276-17-vH-[hTCRa-T48C-R251L-opt] | 3495 | 9381 |
| CD324 | CD8SP-CD324-SC10-6-vL-[hTCRb-S57C-opt]-F-P2A-SP-CD324-SC10-6-vH-[hTCRa-T48C-R251L-opt] | 3496 | 9382 |
| CD324 | CD8SP-CD324-hSC10-17-vL-[hTCRb-S57C-opt]-F-P2A-SP-CD324-hSC10-17-vH-[hTCRa-T48C-R251L-opt] | 3497 | 9383 |
| CDH6 | CD8SP-CDH6-NOV710-vL-[hTCRb-S57C-opt]-F-P2A-SP-CDH6-NOV710-vH-[hTCRa-T48C-R251L-opt] | 3498 | 9384 |
| CDH6 | CD8SP-CDH6-NOV712-vL-[hTCRb-S57C-opt]-F-P2A-SP-CDH6-NOV712-vH-[hTCRa-T48C-R251L-opt] | 3499 | 9385 |
| CDH17 | CD8SP-CDH17-PTA001A4-vL-[hTCRb-S57C-opt]-F-P2A-SP-CDH17-PTA001A4-vH-[hTCRa-T48C-R251L-opt] | 3500 | 9386 |
| CDH19 | CD8SP-CDH19-16A4-vL-[hTCRb-S57C-opt]-F-P2A-SP-CDH19-16A4-vH-[hTCRa-T48C-R251L-opt] | 3501 | 9387 |

TABLE 13-continued

EXEMPLARY SIRs WITH hTCRa-T48C-R251L-opt CHAIN

| Target | Name of CAR constructs including the name of antigen binding domain | SEQ ID NO (DNA) | SEQ ID NO (PRT) |
|---|---|---|---|
| EGFR | CD8SP-Cetuximab-vL-[hTCRb-S57C-opt]-F-P2A-SP-Cetuximab-vH-[hTCRa-T48C-R251L-opt] | 3502 | 9388 |
| CLEC5A | CD8SP-CLEC5A-8H8F5-vL-[hTCRb-S57C-opt]-F-P2A-SP-CLEC5A-8H8F5-vH-[hTCRa-T48C-R251L-opt] | 3503 | 9389 |
| CLEC5A | CD8SP-CLEC5A-3E12A2-vL-[hTCRb-S57C-opt]-F-P2A-SP-CLEC5A-3E12A2-vH-[hTCRa-T48C-R251L-opt] | 3504 | 9390 |
| CLL1 | CD8SP-CLL1-M26-vL-[hTCRb-S57C-opt]-F-P2A-SP-CLL1-M26-vH-[hTCRa-T48C-R251L-opt] | 3505 | 9391 |
| CLL1 | CD8SP-CLL1-M32-vL-[hTCRb-S57C-opt]-F-P2A-SP-CLL1-M32-vH-[hTCRa-T48C-R251L-opt] | 3506 | 9392 |
| CS1 | CD8SP-CS1-huLuc63-vL-[hTCRb-S57C-opt]-F-P2A-SP-huLuc63-vH-[hTCRa-T48C-R251L-opt] | 3507 | 9393 |
| CS1 | CD8SP-HuLuc64-vL-[hTCRb-S57C-opt]-F-P2A-SP-HuLuc64-vH-[hTCRa-T48C-R251L-opt] | 3508 | 9394 |
| CS1 | CD8SP-CS1-huLuc90-vL-[hTCRb-S57C-opt]-F-P2A-SP-huLuc90-vH-[hTCRa-T48C-R251L-opt] | 3509 | 9395 |
| CSF2RA | CD8SP-CSF2RA-Ab6-vL-[hTCRb-S57C-opt]-F-P2A-SP-CSF2RA-Ab6-vH-[hTCRa-T48C-R251L-opt] | 3510 | 9396 |
| CSF2RA | CD8SP-CSF2RA-Ab1-vL-[hTCRb-S57C-opt]-F-P2A-SP-CSF2RA-Ab1-vH-[hTCRa-T48C-R251L-opt] | 3511 | 9397 |
| DLL3 | CD8SP-DLL3-hSC16-13-vL-[hTCRb-S57C-opt]-F-P2A-SP-DLL3-hSC16-13-vH-[hTCRa-T48C-R251L-opt] | 3512 | 9398 |
| DLL3 | CD8SP-DLL3-hSC16-56-vL-[hTCRb-S57C-opt]-F-P2A-SP-DLL3-hSC16-56-vH-[hTCRa-T48C-R251L-opt] | 3513 | 9399 |
| EGFRvIII | CD8SP-EGFRvIII-139-vL-[hTCRb-S57C-opt]-F-P2A-SP-EGFRvIII-139-vH-[hTCRa-T48C-R251L-opt] | 3514 | 9400 |
| EGFRvIII | CD8SP-EGFRvIII-2173-vH-[hTCRb-S57C-opt]-F-P2A-SP-EGFRvIII-2173-vH-[hTCRa-T48C-R251L-opt] | 3515 | 9401 |
| EpCam1 | CD8SP-Epcam1-MM1-vL-[hTCRb-S57C-opt]-F-P2A-SP-Epcam1-MM1-vH-[hTCRa-T48C-R251L-opt] | 3516 | 9402 |
| EpCam1 | CD8SP-Epcam1-D5K5-vL-[hTCRb-S57C-opt]-F-P2A-SP-Epcam1-D5K5-vH-[hTCRa-T48C-R251L-opt] | 3517 | 9403 |
| FLT3 | CD8SP-FLT3-NC7-vL-[hTCRb-S57C-opt]-F-P2A-SP-FLT3-NC7-vH-[hTCRa-T48C-R251L-opt] | 3518 | 9404 |
| FITC | CD8SP-FITC-vL-[hTCRb-S57C-opt]-F-P2A-SP-FITC-vH-[hTCRa-T48C-R251L-opt] | 3519 | 9405 |
| Folate Receptor 1 | CD8SP-FR1-huMov19-vL-[hTCRb-S57C-opt]-F-P2A-SP-FR1-huMov19-vH-[hTCRa-T48C-R251L-opt] | 3520 | 9406 |
| GD2 | CD8SP-GD2-hu14-18-vL-[hTCRb-S57C-opt]-F-P2A-SP-GD2-hu14-18-vH-[hTCRa-T48C-R251L-opt] | 3521 | 9407 |
| GD2 | CD8SP-GD2-hu3F8-vL-[hTCRb-S57C-opt]-F-P2A-SP-GD2-hu3F8-vH-[hTCRa-T48C-R251L-opt] | 3522 | 9408 |
| GD3 | CD8SP-GD3-KM-641-vL-[hTCRb-S57C-opt]-F-P2A-SP-GD3-KM-641-vH-[hTCRa-T48C-R251L-opt] | 3523 | 9409 |
| GFRa4 | CD8SP-GFRAlpha4-P4-6-vL-[hTCRb-S57C-opt]-F-P2A-SP-GFRAlpha4-P4-6-vH-[hTCRa-T48C-R251L-opt] | 3524 | 9410 |
| GFRa4 | CD8SP-GFRa4-P4-10-vL-[hTCRb-S57C-opt]-F-P2A-SP-GFRa4-P4-10-vH-[hTCRa-T48C-R251L-opt] | 3525 | 9411 |
| FUCOSYL-GM1 | CD8SP-GM1-5B2-vL-[hTCRb-S57C-opt]-F-P2A-SP-GM1-5B2-vH-[hTCRa-T48C-R251L-opt] | 3526 | 9412 |
| FUCOSYL-GM1 | CD8SP-GM1-7E5-vL-[hTCRb-S57C-opt]-F-P2A-SP-GM1-7E5-vH-[hTCRa-T48C-R251L-opt] | 3527 | 9413 |
| GPRC5D | CD8SP-GPRC5D-ET150-5-vL-[hTCRb-S57C-opt]-F-P2A-SP-GPRC5D-ET150-5-vH-[hTCRa-T48C-R251L-opt] | 3528 | 9414 |
| GPRC5D | CD8SP-GPRC5D-ET150-18-vL-[hTCRb-S57C-opt]-F-P2A-SP-GPRC5D-ET150-18-vH-[hTCRa-T48C-R251L-opt] | 3529 | 9415 |
| GPC3 | CD8SP-GPC3-4E5-vL-[hTCRb-S57C-opt]-F-P2A-SP-GPC3-4E5-vH-[hTCRa-T48C-R251L-opt] | 3530 | 9416 |
| gpNMB | CD8SP-gpNMB-115-vL-[hTCRb-S57C-opt]-F-P2A-SP-gpNMB-115-vH-[hTCRa-T48C-R251L-opt] | 3531 | 9417 |
| Her2 | CD8SP-Her2-Hu4D5-vL-[hTCRb-S57C-opt]-F-P2A-SP-Her2-Hu4D5-vH-[hTCRa-T48C-R251L-opt] | 3532 | 9418 |
| HIV1-env | CD8SP-HIV1-3BNC117-vL-[hTCRb-S57C-opt]-F-P2A-SP-HIV1-3BNC117-vH-[hTCRa-T48C-R251L-opt] | 3533 | 9419 |
| HIV1-env | CD8SP-HIV1-PGT-128-vL-[hTCRb-S57C-opt]-F-P2A-SP-vH-[hTCRa-T48C-R251L-opt] | 3534 | 9420 |
| HIV1-env | CD8SP-HIV1-VR-C01-vL-[hTCRb-S57C-opt]-F-P2A-SP-HIV1-VR-C01-vH-[hTCRa-T48C-R251L-opt] | 3535 | 9421 |
| HIV1-env | CD8SP-HIV1-X5-vL-[hTCRb-S57C-opt]-F-P2A-SP-HIV1-X5-vH-[hTCRa-T48C-R251L-opt] | 3536 | 9422 |
| IL11Ra | CD8SP-IL11Ra-8E2-Ts107-vL-[hTCRb-S57C-opt]-F-P2A-SP-IL11Ra-8E2-Ts107-vH-[hTCRa-T48C-R251L-opt] | 3537 | 9423 |
| IL6Ra & CD19 | IgHSP-IL6R-304-vHH-[hTCRb-S57C-opt]-F-P2A-SP-FMC63-scFV-[hTCRa-T48C-R251L-opt] | 3538 | 9424 |
| IL13Ra2 | CD8SP-IL13Ra2-hu107-vL-[hTCRb-S57C-opt]-F-P2A-SP-IL13Ra2-hu107vH-[hTCRa-T48C-R251L-opt] | 3539 | 9425 |
| IL13Ra2 | CD8SP-IL13Ra2-Hu108-vL-[hTCRb-S57C-opt]-F-P2A-SP-IL13Ra2-Hu108-vH-[hTCRa-T48C-R251L-opt] | 3540 | 9426 |

TABLE 13-continued

EXEMPLARY SIRs WITH hTCRa-T48C-R251L-opt CHAIN

| Target | Name of CAR constructs including the name of antigen binding domain | SEQ ID NO (DNA) | SEQ ID NO (PRT) |
|---|---|---|---|
| LAMP1 | CD8SP-LAMP1-humab1-2-vL-[hTCRb-S57C-opt]-F-P2A-SP-LAMP1-humab1-2vH-[hTCRa-T48C-R251L-opt] | 3541 | 9427 |
| LAMP1 | CD8SP-LAMP1-Mb4-vL-[hTCRb-S57C-opt]-F-P2A-SP-LAMP1-Mb4-vH-[hTCRa-T48C-R251L-opt] | 3542 | 9428 |
| LewisY | CD8SP-LewisY-huS193-vL-[hTCRb-S57C-opt]-F-P2A-SP-LewisY-huS193-vH-[hTCRa-T48C-R251L-opt] | 3543 | 9429 |
| Li CAM | CD8SP-L1CAM-9-3-HU3-vL-[hTCRb-S57C-opt]-F-P2A-SP-L1CAM-9-3-HU3-vH-[hTCRa-T48C-R251L-opt] | 3544 | 9430 |
| Lym1 | CD8SP-Lym1-vL-[hTCRb-S57C-opt]-F-P2A-SP-Lym1-vH-[hTCRa-T48C-R251L-opt] | 3545 | 9431 |
| Lym2 | CD8SP-Lym2-vL-[hTCRb-S57C-opt]-F-P2A-SP-Lym2-vH-[hTCRa-T48C-R251L-opt] | 3546 | 9432 |
| CD79b | CD8SP-huMA79bv28-vL-[hTCRb-S57C-opt]-F-P2A-SP-huMA79bv28-vH-[hTCRa-T48C-R251L-opt] | 3547 | 9433 |
| Mesothelin | CD8SP-Mesothelin-m912-vL-[hTCRb-S57C-opt]-F-P2A-SP-m912-vH-[hTCRa-T48C-R251L-opt] | 3548 | 9434 |
| MPL | CD8SP-MPL-175-vL-[hTCRb-S57C-opt]-F-P2A-SP-175-vH-[hTCRa-T48C-R251L-opt] | 3549 | 9435 |
| MPL | CD8SP-MPL-161-vL-[hTCRb-S57C-opt]-F-P2A-SP-161-vH-[hTCRa-T48C-R251L-opt] | 3550 | 9436 |
| MPL | CD8SP2-MPL-111-vL-[hTCRb-S57C-opt]-F-P2A-SP-MPL-111-vH-[hTCRa-T48C-R251L-opt] | 3551 | 9437 |
| Muc1 | CD8SP-Muc1-D6-M3B8-vL-[hTCRb-S57C-opt]-F-P2A-SP-Muc1-D6-M3B8-vH-[hTCRa-T48C-R251L-opt] | 3552 | 9438 |
| Muc1 | CD8SP-MUC1-D6-M3A1-vL-[hTCRb-S57C-opt]-F-P2A-SP-MUC1-D6-M3A1-vH-[hTCRa-T48C-R251L-opt] | 3553 | 9439 |
| Muc16 | CD8SP-Muc16-4H11-vL-[hTCRb-S57C-opt]-F-P2A-SP-Muc16-4H11-vH-[hTCRa-T48C-R251L-opt] | 3554 | 9440 |
| EGFR | CD8SP-Nimotuzumab-vL-[hTCRb-S57C-opt]-F-P2A-SP-Nimotuzumab-vH-[hTCRa-T48C-R251L-opt] | 3555 | 9441 |
| NKG2D | CD8SP-NKG2D-MS-vL-[hTCRb-S57C-opt]-F-P2A-SP-NKG2D-MS-vH-[hTCRa-T48C-R251L-opt] | 3556 | 9442 |
| NYBR1 | CD8SP-NYBR1-vL-[hTCRb-S57C-opt]-F-P2A-SP-NYBR1-vH-[hTCRa-T48C-R251L-opt] | 3557 | 9443 |
| NY-ESO | CD8SP-NYESO-T1-vL-[hTCRb-S57C-opt]-F-P2A-SP-NYESO-T1-vH-[hTCRa-T48C-R251L-opt] | 3558 | 9444 |
| NY-ESO | CD8SP-NYESO-T1-vL-[hTCRb-S57C-opt]-F-P2A-SP-NYESO-T2-vH-[hTCRa-T48C-R251L-opt] | 3559 | 9445 |
| PDL1 | CD8SP-PDL1-10A5-vL-[hTCRb-S57C-opt]-F-P2A-SP-PDL1-10A5-vH-[hTCRa-T48C-R251L-opt] | 3560 | 9446 |
| PSCA | CD8SP-PSCA-Ha14-121-vL-[hTCRb-S57C-opt]-F-P2A-SP-PSCA-Ha14-121-vH-[hTCRa-T48C-R251L-opt] | 3561 | 9447 |
| PSCA | CD8SP-PSCA-Ha14-117-vL-[hTCRb-S57C-opt]-F-P2A-SP-PSCA-Ha14-117-vH-[hTCRa-T48C-R251L-opt] | 3562 | 9448 |
| PR1 | CD8SP-PR1-vL-[hTCRb-S57C-opt]-F-P2A-SP-PR1-vH-[hTCRa-T48C-R251L-opt] | 3563 | 9449 |
| PSMA | CD8SP-PSMA-006-vL-[hTCRb-S57C-opt]-F-P2A-SP-PSMA-006-vH-[hTCRa-T48C-R251L-opt] | 3564 | 9450 |
| PSMA | CD8SP-PSMA-J591-vL-[hTCRb-S57C-opt]-F-P2A-SP-PSMA-J591-vH-[hTCRa-T48C-R251L-opt] | 3565 | 9451 |
| PTK7 | CD8SP-PTK7-hSC6-23-vL-[hTCRb-S57C-opt]-F-P2A-SP-PTK7-hSC6-23-vH-[hTCRa-T48C-R251L-opt] | 3566 | 9452 |
| PTK7 | CD8SP-PTK7-SC6-10-2-vL-[hTCRb-S57C-opt]-F-P2A-SP-PTK7-SC6-10-2-vH-[hTCRa-T48C-R251L-opt] | 3567 | 9453 |
| SLea | CD8SP-SLea-7E3-vL-[hTCRb-S57C-opt]-F-P2A-SP-SLea-7E3-vH-[hTCRa-T48C-R251L-opt] | 3568 | 9454 |
| SLea | CD8SP-SLea-5B1-vL-[hTCRb-S57C-opt]-F-P2A-SP-SLea-5B1-vH-[hTCRa-T48C-R251L-opt] | 3569 | 9455 |
| SSEA4 | CD8SP-SSEA4-vL-[hTCRb-S57C-opt]-F-P2A-SP-SSEA4-vH-[hTCRa-T48C-R251L-opt] | 3570 | 9456 |
| TCRB1 | CD8SP-TCRB1-CP01-E09-vL-[hTCRb-S57C-opt]-F-P2A-SP-TCRB1-CP01-E09-vH-[hTCRa-T48C-R251L-opt] | 3571 | 9457 |
| TCRB1 | CD8SP-TCRB1-Jovi1-vL-[hTCRb-S57C-opt]-F-P2A-SP-TCRB1-Jovi1-vH-[hTCRa-T48C-R251L-opt] | 3572 | 9458 |
| TCRB2 | CD8SP-TCRB2-CP01-D05-vL-[hTCRb-S57C-opt]-F-P2A-SP-TCRB2-CP01-D05-vH-[hTCRa-T48C-R251L-opt] | 3573 | 9459 |
| TCRB2 | CD8SP-TCRB2-CP01-E05-vL-[hTCRb-S57C-opt]-F-P2A-SP-TCRB2-CP01-E05-vH-[hTCRa-T48C-R251L-opt] | 3574 | 9460 |
| TCRgd | CD8SP-TCRgd-G5-4-vL-[hTCRb-S57C-opt]-F-P2A-SP-TCRgd-G5-4-vH-[hTCRa-T48C-R251L-opt] | 3575 | 9461 |
| TGFBR2 | CD8SP-TGFBR2-Ab1-vL-[hTCRb-S57C-opt]-F-P2A-SP-TGFBR2-Ab1-vH-[hTCRa-T48C-R251L-opt] | 3576 | 9462 |
| TIM1 | CD8SP-TIM1-HVCR1-270-2-vL-[hTCRb-S57C-opt]-F-P2A-SP-TIM1-HVCR1-270-2-vH-[hTCRa-T48C-R251L-opt] | 3577 | 9463 |
| TIM1 | CD8SP-TIM1-HVCR1-ARD5-vL-[hTCRb-S57C-opt]-F-P2A-SP-TIM1-HVCR1-ARD5vH-[hTCRa-T48C-R251L-opt] | 3578 | 9464 |
| TnAg | CD8SP-TnAg-vL-[hTCRb-S57C-opt]-F-P2A-SP-TnAg-vH-[hTCRa-T48C-R251L-opt] | 3579 | 9465 |

TABLE 13-continued

| EXEMPLARY SIRs WITH hTCRa-T48C-R251L-opt CHAIN | | | |
|---|---|---|---|
| Target | Name of CAR constructs including the name of antigen binding domain | SEQ ID NO (DNA) | SEQ ID NO (PRT) |
| Tn-Muc1 | CD8SP-TnMuc1-hu5E5-RHA8-RKA-2-vL-[hTCRb-S57C-opt]-F-P2A-SP-TnMuc1-hu5E5-RHA8-RKA-2vH-[hTCRa-T48C-R251L-opt] | 3580 | 9466 |
| TROP2 | CD8SP-TROP2-ARA47-HV3KV3-vL-[hTCRb-S57C-opt]-F-P2A-SP-TROP2-ARA47-HV3KV3-vH-[hTCRa-T48C-R251L-opt] | 3581 | 9467 |
| TROP2 | CD8SP-TROP2-h7E6-SVG-vL-[hTCRb-S57C-opt]-F-P2A-SP-TROP2-h7E6-SVG-vH-[hTCRa-T48C-R251L-opt] | 3582 | 9468 |
| TSHR | SP-TSHbOTCRb-S57C-opt]-F-P2A-SP-CGHa-[hTCRa-T48C-R251L-opt] | 3583 | 9469 |
| TSHR | CD8SP-TSHR-K1-70-vL-[hTCRb-S57C-opt]-F-P2A-SP-TSHR-K1-70-vH-[hTCRa-T48C-R251L-opt] | 3584 | 9470 |
| TSHR | CD8SP-TSHR-KB1-vL-[hTCRb-S57C-opt]-F-P2A-SP-TSHR-KB1-vH-[hTCRa-T48C-R251L-opt] | 3585 | 9471 |
| TSHR | CD8SP-TSHR-5C9-vL-[hTCRb-S57C-opt]-F-P2A-SP-TSHR-5C9-vH-[hTCRa-T48C-R251L-opt] | 3586 | 9472 |
| TSLPR | CD8SP-TSLPR-vL-[hTCRb-S57C-opt]-F-P2A-SP-TSLPR-vH-[hTCRa-T48C-R251L-opt] | 3587 | 9473 |
| VEGFR3 | CD8SP-VEGFR3-Ab1-vL-[hTCRb-S57C-opt]-F-P2A-SP-VEGFR3-Ab1-vH-[hTCRa-T48C-R251L-opt] | 3588 | 9474 |
| WT1 | CD8SP-WT1-Ab5-vL-[hTCRb-S57C-opt]-F-P2A-SP-WT1-Ab5-vH-[hTCRa-T48C-R251L-opt] | 3589 | 9475 |
| WT1 | CD8SP-MYC3-WT1-Ab13-vL-[hTCRb-S57C-opt]-F-P2A-SP-WT1-Ab13-vH-[hTCRa-T48C-R251L-opt] | 3590 | 9476 |
| WT1 | CD8SP-MYC3-WT1-Ab15-vL-[hTCRb-S57C-opt]-F-P2A-SP-WT1-Ab15-vH-[hTCRa-T48C-R251L-opt] | 3591 | 9477 |
| CD123 | CD8SP-CD123-1172-vL-[hTCRb-S57C-opt]-F-P2A-SP-CD123-1172-vH-[hTCRa-T48C-R251L-opt] | 3592 | 9478 |
| CDH19 | CD8SP-CDH19-4B10-vL-[hTCRb-S57C-opt]-F-P2A-SP-CDH19-4B10-vH-[hTCRa-T48C-R251L-opt] | 3593 | 9479 |
| LHR | CD8SP-LHR-8B7-vL-[hTCRb-S57C-opt]-F-P2A-SP-LHR-8B7-vH-[hTCRa-T48C-R251L-opt] | 3594 | 9480 |
| LHR | CD8SP-LHR-5F4-21-vL-[hTCRb-S57C-opt]-F-P2A-SP-LHR-5F4-21-vH-[hTCRa-T48C-R251L-opt] | 3595 | 9481 |
| B7H4 | CD8SP-B7H4-hu22Cl0-vL-[hTCRb-S57C-opt]-F-P2A-SP-B7H4-hu22Cl0-vH-[hTCRa-T48C-R251L-opt] | 3596 | 9482 |
| B7H4 | CD8SP-B7H4-hu1D11-vL-[hTCRb-S57C-opt]-F-P2A-SP-B7H4-hu1D11-vH-[hTCRa-T48C-R251L-opt] | 3597 | 9483 |

TABLE 13-continued

| EXEMPLARY SIRs WITH hTCRa-T48C-R251L-opt CHAIN | | | |
|---|---|---|---|
| Target | Name of CAR constructs including the name of antigen binding domain | SEQ ID NO (DNA) | SEQ ID NO (PRT) |
| CD23 | CD8SP-CD23-p5E8-vL-[hTCRb-S57C-opt]-F-P2A-SP-CD23-p5E8-vH-[hTCRa-T48C-R251L-opt] | 3598 | 9484 |
| GCC | CD8SP-GCC-5F9-vL-[hTCRb-S57C-opt]-F-P2A-SP-GCC-5F9-vH-[hTCRa-T48C-R251L-opt] | 3599 | 9485 |
| GCC | CD8SP-GCC-Ab229-vL-[hTCRb-S57C-opt]-F-P2A-SP-GCC-Ab229-vH-[hTCRa-T48C-R251L-opt] | 3600 | 9486 |
| CD200R | CD8SP-CD200R-huDx182-vL-[hTCRb-S57C-opt]-F-P2A-SP-CD200R-huDx182-vH-[hTCRa-T48C-R251L-opt] | 3601 | 9487 |
| AFP/MHC I | CD8SP-AFP-61-vL-[hTCRb-S57C-opt]-F-P2A-SP-AFP-61-vH-[hTCRa-T48C-R251L-opt] | 3602 | 9488 |
| AFP/MHC I | CD8SP-AFP-76-vL-[hTCRb-S57C-opt]-F-P2A-SP-AFP-76-vH-[hTCRa-T48C-R251L-opt] | 3603 | 9489 |
| AFP/MHC I | CD8SP-AFP-79-vL-[hTCRb-S57C-opt]-F-P2A-SP-AFP-79-vH-[hTCRa-T48C-R251L-opt] | 3604 | 9490 |
| BCMA | CD8SP-BCMA-ET-03-vL-[hTCRb-S57C-opt]-F-P2A-SP-BCMA-ET-03-vH-[hTCRa-T48C-R251L-opt] | 3605 | 9491 |
| BCMA | CD8SP-BCMA-huC11.D5.3L1H3-vL-[hTCRb-S57C-opt]-F-P2A-SP-BCMA-huC11.D5.3L1H3-vH-[hTCRa-T48C-R251L-opt] | 3606 | 9492 |
| BCMA | CD8SP-BCMA-huC13-F12-vL-[hTCRb-S57C-opt]-F-P2A-SP-BCMA-huC13-F12-vH-[hTCRa-T48C-R251L-opt] | 3607 | 9493 |
| CD123 | CD8SP-CD123-DART-1-vL-[hTCRb-S57C-opt]-F-P2A-SP-CD123-DART-1-vH-[hTCRa-T48C-R251L-opt] | 3608 | 9494 |
| CD123 | CD8SP-CD123-DART-2-vL-[hTCRb-S57C-opt]-F-P2A-SP-CD123-DART-2-vH-[hTCRa-T48C-R251L-opt] | 3609 | 9495 |
| CD123 | CD8SP-CD123-13RB18-vL-[hTCRb-S57C-opt]-F-P2A-SP-CD123-13RB18-vH-[hTCRa-T48C-R251L-opt] | 3610 | 9496 |
| CD123 | CD8SP-CD123-hu3E3-vL-[hTCRb-S57C-opt]-F-P2A-SP-CD123-hu3E3-vH-[hTCRa-T48C-R251L-opt] | 3611 | 9497 |
| CD123 | CD8SP-CD123-9F6-vL-[hTCRb-S57C-opt]-F-P2A-SP-CD123-9F6-vH-[hTCRa-T48C-R251L-opt] | 3612 | 9498 |
| CD123 | CD8SP-CD123-I3RB2-vL-[hTCRb-S57C-opt]-F-P2A-SP-CD123-I3RB2-vH-[hTCRa-T48C-R251L-opt] | 3613 | 9499 |
| CD123 | CD8SP-CD123-1176-vL-[hTCRb-S57C-opt]-F-P2A-SP-CD123-1176-vH-[hTCRa-T48C-R251L-opt] | 3614 | 9500 |
| CD123 | CD8SP-CD123-8B11-vL-[hTCRb-S57C-opt]-F-P2A-SP-CD123-8B11-vH-[hTCRa-T48C-R251L-opt] | 3615 | 9501 |
| CD123 | CD8SP-CD123-2B8-vL-[hTCRb-S57C-opt]-F-P2A-SP-CD123-2B8-vH-[hTCRa-T48C-R251L-opt] | 3616 | 9502 |

TABLE 13-continued

EXEMPLARY SIRs WITH hTCRa-T48C-R251L-opt CHAIN

| Target | Name of CAR constructs including the name of antigen binding domain | SEQ ID NO (DNA) | SEQ ID NO (PRT) |
|---|---|---|---|
| CD123 | CD8SP-CD123-9D7-vL-[hTCRb-S57C-opt]-F-P2A-SP-CD123-9D7-vH-[hTCRa-T48C-R251L-opt] | 3617 | 9503 |
| CD123 | CD8SP-CD123-3B10-vL-[hTCRb-S57C-opt]-F-P2A-SP-CD123-3B10-vH-[hTCRa-T48C-R251L-opt] | 3618 | 9504 |
| CD19 | CD8SP-CD19-MOR0028-vL-[hTCRb-S57C-opt]-F-P2A-SP-CD19-MOR0028-vH-[hTCRa-T48C-R251L-opt] | 3619 | 9505 |
| CD19 | CD8SP-CD19-hu-mROO5-vL-[hTCRb-S57C-opt]-F-P2A-SP-CD19-hu-mROO5-vH-[hTCRa-T48C-R251L-opt] | 3620 | 9506 |
| CD20 | CD8SP-CD20-Leu16-vL-[hTCRb-S57C-opt]-F-P2A-SP-CD20-Leu16-vH-PaCRa-T48C-R251L-opt] | 3621 | 9507 |
| CD20 | CD8SP-CD20-11B8-vL-[hTCRb-S57C-opt]-F-P2A-SP-CD20-11B8-vH-[hTCRa-T48C-R251L-opt] | 3622 | 9508 |
| CD20 | CD8SP-CD20-2C6-vL-[hTCRb-S57C-opt]-F-P2A-SP-CD20-2C6-vH-[hTCRa-T48C-R251L-opt] | 3623 | 9509 |
| CD20 | CD8SP-CD20-2H7-vL-[hTCRb-S57C-opt]-F-P2A-SP-CD20-2H7-vH-[hTCRa-T48C-R251L-opt] | 3624 | 9510 |
| CD20 | CD8SP-CD20-Ubli-v4-vL-[hTCRb-S57C-opt]-F-P2A-SP-CD20-Ubli-v4-vH-[hTCRa-T48C-R251L-opt] | 3625 | 9511 |
| CD20 | CD8SP-CD20-h1F5-vL-[hTCRb-S57C-opt]-F-P2A-SP-CD20-h1F5-vH-[hTCRa-T48C-R251L-opt] | 3626 | 9512 |
| CD20 | CD8SP-CD20-7D8-vL-[hTCRb-S57C-opt]-F-P2A-SP-CD20-7D8-vH-[hTCRa-T48C-R251L-opt] | 3627 | 9513 |
| CD33 | CD8SP-CD33-Boehr2800308-vL-[hTCRb-S57C-opt]-F-P2A-SP-CD33-Boehr2800308-vH-[hTCRa-T48C-R251L-opt] | 3628 | 9514 |
| CD33 | CD8SP-CD33-Him3-4-vL-[hTCRb-S57C-opt]-F-P2A-SP-CD33-Him3-4-vH-[hTCRa-T48C-R251L-opt] | 3629 | 9515 |
| CD33 | CD8SP-CD33-SGNh2H12-vL-[hTCRb-S57C-opt]-F-P2A-SP-CD33-SGNh2H12-vH-[hTCRa-T48C-R251L-opt] | 3630 | 9516 |
| CD33 | CD8SP-CD33-15G15-33-vL-[hTCRb-S57C-opt]-F-P2A-SP-CD33-15G15-33-vH-[hTCRa-T48C-R251L-opt] | 3631 | 9517 |
| CD33 | CD8SP-CD33-33H4-vL-[hTCRb-S57C-opt]-F-P2A-SP-CD33-33H4-vH-[hTCRa-T48C-R251L-opt] | 3632 | 9518 |
| CD33 | CD8SP-CD33-33H4-2-vL-[hTCRb-S57C-opt]-F-P2A-SP-CD33-33H4-2-vH-[hTCRa-T48C-R251L-opt] | 3633 | 9519 |
| CD33 | CD8SP-CD33-9C3-2-vL-[hTCRb-S57C-opt]-F-P2A-SP-CD33-9C3-2-vH-[hTCRa-T48C-R251L-opt] | 3634 | 9520 |
| CD99 | CD8SP-CD99-hu12E7-vL-[hTCRb-S57C-opt]-F-P2A-SP-CD99-hu12E7-vH-[hTCRa-T48C-R251L-opt] | 3635 | 9521 |

TABLE 13-continued

EXEMPLARY SIRs WITH hTCRa-T48C-R251L-opt CHAIN

| Target | Name of CAR constructs including the name of antigen binding domain | SEQ ID NO (DNA) | SEQ ID NO (PRT) |
|---|---|---|---|
| CLL1 | CD8SP-CLL1-21C9-L2H3-vL-[hTCRb-S57C-opt]-F-P2A-SP-CLL1-21C9-L2H3-vH-[hTCRa-T48C-R251L-opt] | 3636 | 9522 |
| CLL1 | CD8SP-CLL1-6E7L4H1e-vL-[hTCRb-S57C-opt]-F-P2A-SP-CLL1-6E7L4H1e-vH-[hTCRa-T48C-R251L-opt] | 3637 | 9523 |
| CLL1 | CD8SP-CLL1-hu1075-v1-vL-[hTCRb-S57C-opt]-F-P2A-SP-CLL1-hu1075-v1-vH-[hTCRa-T48C-R251L-opt] | 3638 | 9524 |
| CLL1 | CD8SP-CLL1-hu1075-v2-vL-[hTCRb-S57C-opt]-F-P2A-SP-CLL1-hu1075-v2-vH-[hTCRa-T48C-R251L-opt] | 3639 | 9525 |
| CS1 | CD8SP-CS1-PDL241-vL-[hTCRb-S57C-opt]-F-P2A-SP-CS1-PDL241-vH-[hTCRa-T48C-R251L-opt] | 3640 | 9526 |
| CS1 | CD8SP-CS1-Hu27A-vL-[hTCRb-S57C-opt]-F-P2A-SP-CS1-Hu27A-vH-[hTCRa-T48C-R251L-opt] | 3641 | 9527 |
| CS1 | CD8SP-CS1-ScHu34C3-vL-[hTCRb-S57C-opt]-F-P2A-SP-CS1-ScHu34C3-vH-[hTCRa-T48C-R251L-opt] | 3642 | 9528 |
| CS1 | CD8SP-CS1-Hu31-D2-vL-[hTCRb-S57C-opt]-F-P2A-SP-CS1-Hu31-D2-vH-[hTCRa-T48C-R251L-opt] | 3643 | 9529 |
| CS1 | CD8SP-CS1-Luc34-vL-[hTCRb-S57C-opt]-F-P2A-SP-CS1-Luc34-vH-[hTCRa-T48C-R251L-opt] | 3644 | 9530 |
| CS1 | CD8SP-CS1-LucX2-vL-[hTCRb-S57C-opt]-F-P2A-SP-CS1-LucX2-vH-[hTCRa-T48C-R251L-opt] | 3645 | 9531 |
| FITC | CD8SP-FITC-4M-53-vL-[hTCRb-S57C-opt]-F-P2A-SP-FITC-4M-53-vH-[hTCRa-T48C-R251L-opt] | 3646 | 9532 |
| FITC | CD8SP-FITC-E2-vH-[hTCRb-S57C-opt]-F-P2A-SP-FITC-E2-vL-[hTCRa-T48C-R251L-opt] | 3647 | 9533 |
| GPRC5D | CD8SP-GPRC5D-ET150-1-vL-[hTCRb-S57C-opt]-F-P2A-SP-GPRC5D-ET150-1-vH-[hTCRa-T48C-R251L-opt] | 3648 | 9534 |
| GPRC5D | CD8SP-GPRC5D-ET150-2-vL-[hTCRb-S57C-opt]-F-P2A-SP-GPRC5D-ET150-2-vH-[hTCRa-T48C-R251L-opt] | 3649 | 9535 |
| HLA-A2 | CD8SP-HLA-A2-3PB2-vL-[hTCRb-S57C-opt]-F-P2A-SP-HLA-A2-3PB2-vH-[hTCRa-T48C-R251L-opt] | 3650 | 9536 |
| HPV16-E7/MHC I | CD8SP-HPV16-7-8-vL-[hTCRb-S57C-opt]-F-P2A-SP-HPV16-7-8-vH-[hTCRa-T48C-R251L-opt] | 3651 | 9537 |
| HPV16-E7/MHC I | CD8SP-HPV16-2-vL-[hTCRb-S57C-opt]-F-P2A-SP-HPV16-2-vH-[hTCRa-T48C-R251L-opt] | 3652 | 9538 |
| Tissue Factor 1 (TF1) | CD8SP-TF1-98-vL-[hTCRb-S57C-opt]-F-P2A-SP-TF1-98-vH-[hTCRa-T48C-R251L-opt] | 3653 | 9539 |
| Tn-Muc1 | CD8SP-Tn-Muc1-5E5-vH-[hTCRb-S57C-opt]-F-P2A-SP-Tn-Muc1-5E5-vL-[hTCRa-T48C-R251L-opt] | 3654 | 9540 |

TABLE 13-continued

| EXEMPLARY SIRs WITH hTCRa-T48C-R251L-opt CHAIN | | | |
|---|---|---|---|
| Target | Name of CAR constructs including the name of antigen binding domain | SEQ ID NO (DNA) | SEQ ID NO (PRT) |
| CD22 | CD8SP-CD22-5-vH-[hTCRb-S57C-opt]-F-P2A-SP-CD22-5-vL-[hTCRa-T48C-R251L-opt] | 3655 | 9541 |
| CD22 | CD8SP-CD22-10-vH-[hTCRb-S57C-opt]-F-P2A-SP-CD22-10-vL-[hTCRa-T48C-R251L-opt] | 3656 | 9542 |
| CD22 | CD8SP-CD22-31-vH-[hTCRb-S57C-opt]-F-P2A-SP-CD22-31-vL-[hTCRa-T48C-R251L-opt] | 3657 | 9543 |
| CD22 | CD8SP-CD22-53-vH-[hTCRb-S57C-opt]-F-P2A-SP-CD22-53-vL-[hTCRa-T48C-R251L-opt] | 3658 | 9544 |
| CD22 | CD8SP-CD22-65-vH-[hTCRb-S57C-opt]-F-P2A-SP-CD22-65-vL-[hTCRa-T48C-R251L-opt] | 3659 | 9545 |
| Igk-Light Chain | CD8SP-Kappa-LC1-vL-[hTCRb-S57C-opt]-F-P2A-SP-Kappa-LC1-vH-[hTCRa-T48C-R251L-opt] | 3660 | 9546 |
| PTK7 | CD8SP-PTK7-7C8-vL-[hTCRb-S57C-opt]-F-P2A-SP-PTK7-7C8-vH-[hTCRa-T48C-R251L-opt] | 3661 | 9547 |
| PTK7 | CD8SP-PTK7-12C6a-vL-[hTCRb-S57C-opt]-F-P2A-SP-PTK7-12C6a-vH-[hTCRa-T48C-R251L-opt] | 3662 | 9548 |
| CD19 | CD8SP-hCD19-EUK5-13-vL-[hTCRb-S57C-opt]-F-P2A-SP-hCD19-EUK5-13-vH-[hTCRa-T48C-R251L-opt] | 3663 | 9549 |
| Ras/MHC I | CD8SP-Ras-Ab2-vL-[hTCRb-S57C-opt]-F-P2A-SP-Ras-Ab2-vH-[hTCRa-T48C-R251L-opt] | 3664 | 9550 |
| Ras/MHC I | CD8SP-Ras-Ab4-vL-[hTCRb-S57C-opt]-F-P2A-SP-Ras-Ab4-vH-[hTCRa-T48C-R251L-opt] | 3665 | 9551 |
| CLD18A2 | CD8SP-CLD18A2-43A11-vL-[hTCRb-S57C-opt]-F-P2A-SP-CLD18A2-43A11-vH-[hTCRa-T48C-R251L-opt] | 3666 | 9552 |
| CLD18A2 | CD8SP-CLD18A2-175D10-vL-[hTCRb-S57C-opt]-F-P2A-SP-CLD18A2-175D10-vH-[hTCRa-T48C-R251L-opt] | 3667 | 9553 |
| CD43 | CD8SP-CD43-huJL-1-257-10-vL-[hTCRb-S57C-opt]-F-P2A-SP-CD43-huJL-1-257-10-vH-[hTCRa-T48C-R251L-opt] | 3668 | 9554 |
| NY-ESO | CD8SP-NYESO-35-15-vL-[hTCRb-S57C-opt]-F-P2A-SP-NYESO-35-15-vH-[hTCRa-T48C-R251L-opt] | 3669 | 9555 |
| Streptag | CD8SP-Streptag-vL-[hTCRb-S57C-opt]-F-P2A-SP-Streptag-vH-[hTCRa-T48C-R251L-opt] | 3670 | 9556 |
| MPL/TPO-R | CD8SP-MPL-hu-161-2-vL-[hTCRb-S57C-opt]-F-P2A-SP-MPL-hu-161-2-vH-[hTCRa-T48C-R251L-opt] | 3671 | 9557 |
| P-gp (MDR1) | CD8SP-Pgp-MRK16-vL-[hTCRb-S57C-opt]-F-P2A-SP-Pgp-MRK16-vH-[hTCRa-T48C-R251L-opt] | 3672 | 9558 |
| BCMA | CD8SP-BCMA-huC13-F12-L1H2-vL2-[hTCRb-S57C-opt]-F-P2A-SP-BCMA-huC13-F12-L1H2-vH2-[hTCRa-T48C-R251L-opt] | 3673 | 9559 |
| CD179a | CD8SP-CD179a-2460-B04-vL-[hTCRb-S57C-opt]-F-P2A-SP-CD179a-2460-B04-vH-[hTCRa-T48C-R251L-opt] | 3674 | 9560 |
| CD179a | CD8SP-CD179a-2462-E07-vL-[hTCRb-S57C-opt]-F-P2A-SP-CD179a-2462-E07-vH-[hTCRa-T48C-R251L-opt] | 3675 | 9561 |
| MPL/TPO-R | CD8SP-MPL-hu-175-2-vL-[hTCRb-S57C-opt]-F-P2A-SP-MPL-hu-175-2-vH-[hTCRa-T48C-R251L-opt] | 3676 | 9562 |
| MPL | CD8SP-MPL-hu-111-2-vL-[hTCRb-S57C-opt]-F-P2A-SP-MPL-hu-111-2-vH-[hTCRa-T48C-R251L-opt] | 3677 | 9563 |
| CD19 | CD8SP-hu-FMC65-1-vL-[hTCRb-S57C-opt]-F-P2A-SP-hu-FMC65-1-vH-[hTCRa-T48C-R251L-opt] | 3678 | 9564 |
| CD22 | CD8SP-CD22-HA22-vL-[hTCRb-S57C-opt]-F-P2A-SP-CD22-HA22-vH-[hTCRa-T48C-R251L-opt] | 3679 | 9565 |
| STEAP1 | CD8SP-STEAP1-hu120-vL-[hTCRb-S57C-opt]-F-P2A-SP-STEAP1-hu120-vH-[hTCRa-T48C-R251L-opt] | 3680 | 9566 |
| Liv1 | CD8SP-hLiv1-mAb2-vL-[hTCRb-S57C-opt]-F-P2A-SP-hLiv1-mAb2-vH-[hTCRa-T48C-R251L-opt] | 3681 | 9567 |
| Nectin-4 | CD8SP-hu-Nectin4-mAb1-vL-[hTCRb-S57C-opt]-F-P2A-SP-hu-Nectin4-mAb1-vH-[hTCRa-T48C-R251L-opt] | 3682 | 9568 |
| Cripto | CD8SP-hu-Cripto-L1H2-vL-[hTCRb-S57C-opt]-F-P2A-SP-hu-Cripto-L1H2-vH-[hTCRa-T48C-R251L-opt] | 3683 | 9569 |
| gpA33 | CD8SP-hu-gpA33-vL-[hTCRb-S57C-opt]-F-P2A-SP-hu-gpA33-vH-[hTCRa-T48C-R251L-opt] | 3684 | 9570 |
| ROR1 | CD8SP-ROR1-DART4-vL-[hTCRb-S57C-opt]-F-P2A-SP-ROR1-DART4-vH-[hTCRa-T48C-R251L-opt] | 3685 | 9571 |
| FLT3 | CD8SP-FLT3-8B5-vL-[hTCRb-S57C-opt]-F-P2A-SP-FLT3-8B5-vH-[hTCRa-T48C-R251L-opt] | 3686 | 9572 |
| FLT3 | CD8SP-FLT3-10E3-vL-[hTCRb-S57C-opt]-F-P2A-SP-FLT3-10E3-vH-[hTCRa-T48C-R251L-opt] | 3687 | 9573 |
| BCMA | CD8SP-BCMA-AJ-vL-[hTCRb-S57C-opt]-F-P2A-SP-BCMA-AJ-vH-[hTCRa-T48C-R251L-opt] | 3688 | 9574 |
| BCMA | CD8SP-BCMA-FS-vL-[hTCRb-S57C-opt]-F-P2A-SP-BCMA-FS-vH-[hTCRa-T48C-R251L-opt] | 3689 | 9575 |
| BCMA | CD8SP-BCMA-NM-vL-[hTCRb-S57C-opt]-F-P2A-SP-BCMA-NM-vH-[hTCRa-T48C-R251L-opt] | 3690 | 9576 |
| BCMA | CD8SP-BCMA-PC-vL-[hTCRb-S57C-opt]-F-P2A-SP-BCMA-PC-vH-[hTCRa-T48C-R251L-opt] | 3691 | 9577 |
| BCMA | CD8SP-BCMA-PP-vL-[hTCRb-S57C-opt]-F-P2A-SP-BCMA-PP-vH-[hTCRa-T48C-R251L-opt] | 3692 | 9578 |
| BCMA | CD8SP-BCMA-RD-vL-[hTCRb-S57C-opt]-F-P2A-SP-BCMA-RD-vH-[hTCRa-T48C-R251L-opt] | 3693 | 9579 |
| BCMA | CD8SP-BCMA-TS-vL-[hTCRb-S57C-opt]-F-P2A-SP-BCMA-TS-vH-[hTCRa-T48C-R251L-opt] | 3694 | 9580 |

TABLE 13-continued

EXEMPLARY SIRs WITH hTCRa-T48C-R251L-opt CHAIN

| Target | Name of CAR constructs including the name of antigen binding domain | SEQ ID NO (DNA) | SEQ ID NO (PRT) |
|---|---|---|---|
| BCMA | CD8SP-BCMA-BB-CAR02-vL-[hTCRb-S57C-opt]-F-P2A-SP-BCMA-BB-CAR02-vH-[hTCRa-T48C-R251L-opt] | 3695 | 9581 |
| CLL1 | CD8SP-CLL1-24C1-vL-[hTCRb-S57C-opt]-F-P2A-SP-CLL1-24C1-vH-[hTCRa-T48C-R251L-opt] | 3696 | 9582 |
| CLL1 | CD8SP-CLL1-24C8-vL-[hTCRb-S57C-opt]-F-P2A-SP-CLL1-24C8-vH-[hTCRa-T48C-R251L-opt] | 3697 | 9583 |
| Mesothelin | CD8SP-MSLN-7D9-v3-vL-[hTCRb-S57C-opt]-F-P2A-SP-MSLN-7D9-v3-vH-[hTCRa-T48C-R251L-opt] | 3698 | 9584 |
| Mesothelin | CD8SP-MSLN-hu22A10-vL-[hTCRb-S57C-opt]-F-P2A-SP-MSLN-hu22A10-vH-[hTCRa-T48C-R251L-opt] | 3699 | 9585 |
| CD19 | CD8SP-hu-Bu13-vL-[hTCRb-S57C-opt]-F-P2A-SP-hu-Bu13-vH-[hTCRa-T48C-R251L-opt] | 3700 | 9586 |
| BST1/CD157 | CD8SP-hu-BST1-A1-vL-[hTCRb-S57C-opt]-F-P2A-SP-hu-BST1-A1-vH-[hTCRa-T48C-R251L-opt] | 3701 | 9587 |
| BST1/CD157 | CD8SP-hu-BST1-A2-vL-[hTCRb-S57C-opt]-F-P2A-SP-hu-BST1-A2-vH-[hTCRa-T48C-R251L-opt] | 3702 | 9588 |
| BST1/CD157 | CD8SP-hu-BST1-A3-vL-[hTCRb-S57C-opt]-F-P2A-SP-hu-BST1-A3-vH-[hTCRa-T48C-R251L-opt] | 3703 | 9589 |

TABLE 14

GUIDE TO SEQUENCE IDENTIFICATION OF DIFFERENT CONSTRUCTS WITH SEQ ID OF Double Chain (DC)-SIR with hTCRa-T48C-R251L SIR SHOWN IN TABLE 13 SERVING AS REFERENCE

| CONSTRUCT ARCHITECTURE | EXEMPLARY CONSTRUCT | SEQ ID NO DNA | SEQ ID NO PRT |
|---|---|---|---|
| Double Chain (DC)-SIR with hTCRa-T48C-R251L | CD8SP-FMC63-vL-[hTCRb-S57C-opt]-F-P2A-SP-FMC63-vH-[hTCRa-T48C-R251L-opt] | 3461-3703 | 9347-9589 |
| DC-SIR with hTCRa-T48C-G259L-N261A | CD8SP-FMC63-vL-[hTCRb-S57C-opt]-F-P2A-SP-FMC63-vH[hTCRa-T48C-G259L-N261A-opt] | 3705-3947 | 9591-9833 |
| DC-SIR with hTCRa-T48C-R251L | CD8SP-FMC63-vL-[hTCRa-T48C-R251L]-F-F2A-SP-FMC63-vH-[hTCRb-S57C] | 3949-4191 | 9835-10077 |
| DC-SIR with hTCRa-T48C-G259L-N261A | CD8SP-FMC63-vL-[hTCRa-T48C-G259L-N261A]-F-F2A-SP-FMC63-vH-[hTCRb-S57C] | 4193-4435 | 10079-10321 |
| Ab-TCR | CD8SP-FMC63-vL-[IgCL-TCRb-wt2--opt]-F-P2A-SP-FMC63-vH-[IgG1-CH1-TCRa-wt2-opt] | 4437-4679 | 10323-10565 |
| Ab-TCR with IgG1-CH1-TCRa-wt2-R251L | CD8SP-FMC63-vL-[IgCL-TCRb-wt2--opt]-F-P2A-SP-FMC63-vH-[IgG1-CH1-TCRa-wt2-R251L-opt] | 4681-4923 | 10567-10809 |
| Ab-TCR with IgG1-CH1-TCRa-wt2-G259L-N261A | CD8SP-FMC63-vL-[IgCL-TCRb-wt2--opt]-F-P2A-SP-FMC63-vH-[IgG1-CH1-TCRa-wt2-G259L-N261A-opt] | 4925-5167 | 10811-11053 |
| Ab-TCR | CD8SP-FMC63-vL-[IgG1-CH1-TCRa-wt21-F-F2A-SP-FMC63-vH-[IgCL-TCRb-wt2-1 | 5169-5411 | 11055-11297 |
| Ab-TCR with IgG1-CH1-TCRa-wt2-R251L | CD8SP-FMC63-vL-[IgG1-CH1-TCRa-wt2-R251L]-F-F2A-SP-FMC63-vH-[IgCL-TCRb-wt2-1 | 5413-5655 | 11299-11541 |
| Ab-TCR with IgG1-CH1-TCRa-wt2-G259L-N261A | CD8SP-FMC63-vL-[IgG1-CH1-TCRa-wt2-G259L-N261A]-F-F2A-SP-FMC63-vH-[IgCL-TCRb-wt2-] | 5657-5899 | 11543-11785 |

TABLE 15

Exemplary diseases targeted by CARs

| CAR/BiTE "X" TARGET | EXEMPLARY DISEASE TARGETED BY CARs (i.e., conventional CARs and next generation CARs. E.g., SIR, Ab-TCR, and TFP) and T Cell activating bispecific and multispecific antibodies (e.g., BiTE) |
|---|---|
| CD19 | ALL, CLL, lymphoma, lymphoid blast crisis of CML, multiple myeloma, immune disorders |
| ALK | Non Small Cell Lung Cancer (NSCLC), ALCL (anaplastic large cell lymphoma), IMT (inflammatory myofibroblastic tumor), or neuroblastoma |
| CD45 | Blood cancers |
| BCMA | Myeloma, PEL, plasma cell leukemia, Waldenstrom's macroglobinemia |
| CD5 | Blood cancer, T cell leukemia, T cell lymphoma |
| CD20 | Blood cancers, Leukemia, ALL, CLL, lymphoma, immune disorders |
| CD22 | Blood cancers, Leukemia, ALL, CLL, lymphoma, lymphoid blast crisis of CML, immune disorders |
| CD23 | Blood cancers, Leukemia, ALL, CLL, lymphoma, autoimmune disorders |
| CD30 | Hodgkins's lymphoma, Cutaneous T cell lymphoma |
| CD32 | Solid tumors |
| CD33 | Blood cancers, AML, MDS |
| CD34 | Blood cancers, AML, MDS |
| CD44v6 | Blood cancers, AML, MDS |
| CD70 | Blood cancers, lymphoma, myeloma, Waldenstrom's macroglobulinemia, Kidney cancer |
| CD79b | Blood cancers, ALL, Lymphoma |
| CD123 | Blood cancers, AML, MDS |
| CD138 | Blood cancers, Myeloma, PEL, plasma cell leukemia, waldenstrom's macroglobulinemia |
| CD179b | Blood cancers, ALL, Lymphoma |
| CD276/B7-H3 | Ewing's sarcoma, neuroblastoma, rhabdomyosarcoma, ovarian, colorectal and lung cancers |
| CD324 | Solid tumors, esophageal, prostate, colorectal, breast, lung cancers |
| CDH6 | Solid tumors, renal, ovarian, thyroid cancers |
| CDH17 | Adenocarciniomas, gastrointestinal, lung, ovarian, endometrial cancers |
| CDH19 | Solid tumor, Melanoma |
| EGFR | Colon cancer, lung cancer |
| CLEC5A | Blood cancers, Leukemia, AML |
| GR/LHR | Prostate cancer, ovarian cancer or breast cancer |
| CLL1 | Blood cancer, Leukemia |
| CMVpp65 | CMV infection, CMV colitis, CMV pneumonitis |
| CS1 | Blood cancers, myeloma, PEL, plasma cell leukemia |

TABLE 15-continued

Exemplary diseases targeted by CARs

| CAR/BiTE "X" TARGET | EXEMPLARY DISEASE TARGETED BY CARs (i.e., conventional CARs and next generation CARs. E.g., SIR, Ab-TCR, and TFP) and T Cell activating bispecific and multispecific antibodies (e.g., BiTE) |
|---|---|
| CSF2RA | AML, CML, MDS |
| CD123 | Blood cancers, AML, MDS |
| DLL3 | Melanoma, lung cancer or ovarian cancer |
| EBNA3c/MHC I | Epstein Barr virus infection and related diseases including cancers |
| EBV-gp350 | Epstein Barr virus infection and related diseases |
| EGFR | Solid tumors, Colon cancer, lung cancer |
| EGFRvIII | Solid tumors, glioblastoma |
| EpCam1 | Gastrointestinal cancer |
| FLT3 | Blood cancers, AML, MDS, ALL |
| Folate Receptor alpha(FR1 or FOLR1) | Ovarian cancer, NSCLC, endometrial cancer, renal cancer, or other solid tumors |
| FSHR | Prostate cancer, ovarian cancer or breast cancer |
| GD2 | Neuroblastoma |
| GD3 | Melanoma |
| GFRa4 | Cancer, thyroid medullary cancer |
| Fucosyl-GM1(GM1) | Small cell lung cancer |
| GPRC5D | Myeloma, PEL, plasma cell leukemia, waldenstrom's macroglobulinemia |
| gp100 | Melanoma |
| GPC3 | Solid tumors, Lung cancer |
| gpNMB | Melanoma, brain tumors, gastric cancers |
| GRP78 | Myeloma |
| Her2 | Solid tumors, breast cancer, stomach cancer |
| Her3 | Colorectal, breast cancer |
| HMW-MAA | Melanoma |
| HTLV1-TAX/MHC I | HTLV1 infection associated diseases, Adult T cell leukemia-lymphoma |
| IL11Ra | Blood cancers, AML, ALL, CML, MDS, sarcomas |
| IL6Ra | Solid tumors, Liver cancer |
| IL13Ra2 | Glioblastomas |
| KSHV-K8.1 | Kaposi's sarcoma, PEL, Multicentric Castleman's disease |
| LAMP1 | Blood cancers, AML, ALL, MDS, CLL, CML |
| LewisY | Cancers |
| L1CAM | Solid tumors, ovarian, breast, endometrial cancers, melanoma |
| LHR | Prostate cancer, ovarian cancer or breast cancer |
| Lym1 | Blood cancer, Leukemia, Lymphoma |
| Lym2 | Blood cancer, Leukemia, Lymphoma |
| CD79b | Blood cancers, lymphoma |
| MART1/MHC I | Melanoma |
| Mesothelin | Mesothelioma, ovarian cancer, pancreatic cancer |
| Muc1/MHC I | Breast cancer, gastric cancer, colorectal cancer, lung cancer, or other solid tumors |
| Muc16 | Ovarian cancer |
| NKG2D | Leukemia, lymphoma or myeloma |
| NYBR1 | Breast cancer |
| PSCA | Prostate cancer |
| PR1/MHC I | Blood cancer, Leukemia |
| Prolactin Receptor | Breast cancer, chromophobe renal cell cancer |
| PSMA | Prostate cancer |
| PTK7 | Melanoma, lung cancer or ovarian cancer |
| ROR1 | Blood cancer, B cell malignancy, lymphoma, CLL |
| SLea | Pancreatic cancer, colon cancer |
| SSEA4 | Pancreatic cancer |
| Tyrosinase/MHC I | Melanoma |
| TCRB1 | T cell leukemias and lymphomas, autoimmune disorders |
| TCRB2 | T cell leukemias and lymphomas, autoimmune disorders |
| TCRgd | T cell leukemias and lymphomas, autoimmune disorders |
| hTERT | Solid tumors, blood cancers |
| TGFBR2 | Solid tumors, keloid |
| TIM1/HAVCR1 | Kidney cancer, liver cancer |
| TROP2 | Solid tumors, Breast cancer, prostate cancer |

TABLE 15-continued

Exemplary diseases targeted by CARs

| CAR/BiTE "X" TARGET | EXEMPLARY DISEASE TARGETED BY CARs (i.e., conventional CARs and next generation CARs. E.g., SIR, Ab-TCR, and TFP) and T Cell activating bispecific and multispecific antibodies (e.g., BiTE) |
|---|---|
| TSHR | Thyroid cancer, T cell leukemia, T cell Lymphoma |
| TSLPR | Blood cancers, Leukemias, AML, MDS |
| Tyrosinase/MHC I | Melanoma |
| VEGFR3 | Solid tumors |
| WT1/MHC I | Blood cancers, AML |
| Folate Receptorβ | AML, Myeloma |
| B7H4 | Breast cancer or ovarian cancer |
| CD23 | Blood cancers, Leukemias, CLL |
| GCC | Gastrointestinal cancer |
| CD200R | Blood cancers, AML, MDS |
| AFP/MHC I | Solid tumors, Liver cancer |
| CD99 | Liver cancer |
| GPRC5D | Myeloma, waldenstrom's macroglobinemia |
| HPV16-E7/MHC I | HPV16 associated cancers, cervical cancer, head and neck cancers |
| Tissue Factor 1 (TF1) | Solid tumors |
| Tn-Muc1 | Solid tumors and blood cancers |
| Igk-Light Chain | Myeloma, plasma cell leukemia |
| Ras G12V/MHC I | Solid tumors and blood cancers |
| CLD18A2 (Claudin 18.2) | Gastric, pancreatic, esophageal, ovarian, or lung cancer |
| CD43 | Blood cancers, AML |
| NY-ESO-1/MHC I | Myeloma |
| MPL/TPO-R | Blood cancer, AML, MDS, CML, ALL, Myeloproliferative disorders, Polycythemia vera, Myelofibrosis, Essential Polycythemia |
| P-glycoprotein (MDR1) | Renal cancer, liver cancer, Myeloma |
| CD179a | Blood cancers, Acute Leukemia, CLL, ALL, Lymphoma |
| STEAP1 | Gastric or prostate cancer, or lymphoma |
| Liv1 (SLC39A6) | Breast or prostate cancer |
| Nectin4 (PVRL4) | Bladder, renal, cervical, lung, head and neck or breast cancer |
| Cripto (TDGF1) | Colorectal or endometrial or ovarian cancer |
| gpA33 | Colorectal or endometrial or ovarian cancer |
| FLT3 | Blood cancers, AML, ALL, MDS |
| BST1/CD157 | Blood cancers, AML, MDS |
| IL1RAP | Liver, colorectal, cervical, lung or ovarian cancer |
| Chloride channel | Glioma |
| IgE | Allergy |
| HLA-A2 | Graft vs host disease, tissue rejection (SIR Expressed in regulatory T cells) |
| Amyloid | Amyloidoses, alzheimer's disease |
| HIV1-env | HIVI/AIDS and related conditions |
| HIV1-gag | HIVVAIDS and related conditions |
| Influenza A HA | Influenza A infection |

TABLE 16

EXEMPLARY TFP CONSTRUCTS TARGETING DIFFERENT ANTIGENS AND THEIR SEQ ID Nos.

| Target | Name of Exemplary TFP constructs including the name of antigen binding domain | SEQ ID NO (DNA) | SEQ ID NO (PRT) |
|---|---|---|---|
| CD19 | CD8SP-FMC63-(vL-vH)-CD3e-ECDTMCP-opt2 | 12185 | 12200 |
| BCMA | CD8SP-BCMA-huC12A3-L3H3-(vL-vH)-CD3e-ECDTMCP-opt2 | 12186 | 12201 |
| CD20 | CD8SP-CD20-2F2-(vL-vH)-CD3e-ECDTMCP-opt2 | 12187 | 12202 |

TABLE 16-continued

| EXEMPLARY TFP CONSTRUCTS TARGETING DIFFERENT ANTIGENS AND THEIR SEQ ID Nos. | | | |
|---|---|---|---|
| Target | Name of Exemplary TFP constructs including the name of antigen binding domain | SEQ ID NO (DNA) | SEQ ID NO (PRT) |
| CD22 | CD8SP-CD22-5-HL-(vH-vL)-CD3e-ECDTMCP-opt2 | 12188 | 12203 |
| CD33 | CD8SP-CD33-huMyc9-(vL-vH)-CD3e-ECDTMCP-opt2 | 12189 | 12204 |
| CD123 | CD8SP-CD123-1172-(vL-vH)-CD3e-ECDTMCP-opt2 | 12190 | 12205 |
| MPL | CD8SP-MPL-161-(vL-vH)-CD3e-ECDTMCP-opt2 | 12191 | 12206 |
| CD20 | CD8SP-CD30-Ac10-(vL-vH)-CD3e-ECDTMCP-opt2 | 12192 | 12207 |
| CS1 | CD8SP-CS1-huLuc90-(vL-vH)-CD3e-ECDTMCP-opt2 | 12193 | 12208 |
| FLT3 | CD8 SP-FLT3-NC7-(vL-vH)-CD3e-ECDTMCP-opt2 | 12194 | 12209 |
| Lym1 | CD8SP-Lym1-(vL-vH)-CD3e-ECDTMCP-opt2 | 12195 | 12210 |
| Lym2 | CD8SP-Lym2-(vL-vH)-CD3e-ECDTMCP-opt2 | 12196 | 12211 |
| MSLN | CD8SP-MSLN-7D9-(vH-vL)-CD3e-ECDTMCP-opt2 | 12197 | 12212 |
| IL13Ra2 | CD8SP-IL13Ra2-hu107-(vL-vH)-CD3e-ECDTMCP-opt2 | 12198 | 12213 |

TABLE 17

| EXEMPLARY PD1 TARGETING AGENTS | | |
|---|---|---|
| Name of constructs targeting PD1 | SEQ ID NO (DNA) | SEQ ID NO (PRT) |
| PD1-947-(vL-vH) | 11820 | 11865 |
| PD1-947-(vL-vH)-KDEL | 11821 | 11866 |
| PD1-947-(vL-vH)-His | 11822 | 11867 |
| PD1-947-(vL-vH)-dTAG-KDEL | 11823 | 11868 |
| PD1-947-(vL-vH)-ShildTAG-KDEL | 11824 | 11869 |
| CD8SP-PD1-947-(vL-vH)-BBz | 11825 | 11870 |
| CD8SP-PD1-947-(vL-vH)-CD8TM-BB-L4 | 11826 | 11871 |
| CD8SP-PD1-947-(vL-vH)-CD8-Hinge-CD24-GPI | 11827 | 11872 |
| CD8SP-PD1-947-(vL-vH)-CD8TM-BB-L4-dTAG | 11828 | 11873 |
| CD8SP-PD1-947-(vL-vH)-CD8TM-BB-L4-ShildTAG | 11829 | 11874 |
| CD8SP-PD1-947-(vL-vH)-CD28TM-CP-L2 | 11830 | 11875 |
| CD8SP-PD1-947-(vL-vH)-CD28TM-CP-L2-dTAG | 11831 | 11876 |
| CD8SP-PD1-947-(vL-vH)-CD28TM-CP-L2-ShieldTAG | 11832 | 11877 |
| CD8SP-PD1-947-scFV-CD8-HingeminiTM | 11833 | 11878 |

TABLE 18

| GUIDE TO SEQUENCE IDENTIFICATION OF INDICATED PD1 BINDING AGENTS WITH AGENTS BASED ON PD1-947 SHOWN IN TABLE 17 SERVING AS REFERENCE | | | |
|---|---|---|---|
| PD1-BINDIND DOMAIN | EXEMPLARY CONSTRUCT | SEQ ID NO DNA | SEQ ID NO PRT |
| PD1-947 | PD1-947-(vL-vH) | 11820-11833 | 11865-11878 |
| hu-PD1-947 | hu-PD1-947-(vL-vH) | 11835-11848 | 11880-11893 |
| PD1-17 | PD1-17-(vL-vH) | 11850-11863 | 11895-11908 |

TABLE 19

| Exemplary Reporters for cytosolic expression | | |
|---|---|---|
| Exemplary Reporters for cytosolic expression | SEQ ID NO (DNA) | SEQ ID NO (PRT) |
| NLuc (NanoLuc) | 11922 | 12055 |
| Gluc-(Gaussia princeps Luc) | 11921 | 12054 |
| NLuc (NanoLuc) | 11922 | 12055 |
| TLuc (TurboLuc16) | 11923 | 12056 |
| MLuc7 (Metrida longa Luc7) M43L/M110L variant | 11924 | 12057 |
| LoLuc (Lucicutia ovaliformis Luc) | 11925 | 12058 |
| HtLuc (Heterorhabdus tanneri Luc) | 11926 | 12059 |
| PaLuc1 (Pleuromamma abdominalis Luc1) | 11927 | 12060 |
| PaLuc2 (Pleuromamma abdominalis Luc2) | 11928 | 12061 |
| MpLuc1[Metridia pacific a Luc1] | 11929 | 12062 |
| McLuc1 [Metridia curticauda Luc1] | 11930 | 12063 |
| MaLuc1 [Metridia asymmetrica Luc1] | 11931 | 12064 |
| MoLuc1 [Metridia okhotensis Luc1] | 11932 | 12065 |
| MoLuc2 [Metridia okhotensis Luc2] | 11933 | 12066 |
| MLuc39 [Metridia longa Luc39] | 11934 | 12067 |
| PsLuc1 [Pleuromamma scutullata Luc1] | 11935 | 12068 |
| LoLuc 1-3 [Lucicutia ovaliformis Luc1-3] | 11936 | 12069 |
| HtLuc2 [Heterorhabdus tanneri Luc 2] | 11937 | 12070 |
| Lucia-Luc | 11938 | 12071 |
| RLuc (Renilla Luc) | 11939 | 12072 |
| Fluc or FfLuc (Firefly Luc) | 11940 | 12073 |
| LucPPe-146-1H2 | 11941 | 12074 |
| LucPPe-133-1B2 | 11942 | 12075 |
| LucPPe-78-0B10 | 11943 | 12076 |
| LucPPe49-7C6A | 11944 | 12077 |
| LucPpL-81-6G1 | 11945 | 12078 |
| CBGRluc | 11946 | 12079 |
| Embryonic Alkaline Phosphatase (EAP) | 11947 | 12080 |
| mCherry | 11948 | 12081 |
| EGFP (Enhanced Green Fluorescent Protein) | 11949 | 12082 |

TABLE 20

| GUIDE TO SEQUENCE IDENTIFICATION OF INDICATED CONSTRUCTS WITH SEQ ID OF CYTOSOLIC REPORTERS SHOWN IN TABLE 19 SERVING AS REFERENCE | | | |
|---|---|---|---|
| CONSTRUCT ARCHITECTURE | EXEMPLARY CONSTRUCT | SEQ ID NO DNA | SEQ ID NO PRT |
| Cytosolic Reporter | NLuc (NanoLuc) | 11922-11949 | 12055-12082 |
| Membrane attached reporter with CD28 Hinge and Transmembrane Domains | SecNLuc-CD28-Hinge-TM | 11951-11980 | 12084-12113 |
| Membrane attached reporter with CD8 Hinge and Transmembrane Domains | SecNLuc-CD8-Hinge-TM-BB-L4 | 11982-12011 | 12115-12144 |
| Membrane anchored reporter with GPI linker | SecNLuc-GPI | 12013-12042 | 12146-12175 |

TABLE 21

| Miscellaneous Constructs | | |
|---|---|---|
| NAME OF CONSTRUCT OR COMPONENT | SEQ ID NO DNA | SEQ ID NO PRT |
| IRES | 58 | |
| pcDNA3 | 11915 | |
| VSVG-IRES-SecNLuc-CD28-Hinge-TM | 11916 | |
| pSECTAG-A | 12048 | |
| VSVG | 11917 | 12050 |
| FMC63-MYC-CD8TM-BBZ-T2A-eGFP | 11918 | 12051 |
| MSLN-237-HL-MYC-CD8TM-BBZ-T2A-eGFP | 11919 | 12052 |
| VSVG-F-P2A-Nluc | 12044 | 12177 |
| VSVG-F-P2A-SecNLuc-CD28-Hinge-TM | 12045 | 12177 |
| VSVG-F-P2A-SecNLuc-CD8-Hinge-TM-BB-L4 | 12046 | 12179 |
| Psectag-SecNLuc-CD28-Hinge-TM | 12049 | |
| CD8SP-FMC63-(vL-vH)-Myc-BBz-P2A-PDL1 | 3455 | 9341 |
| CD8SP-FMC63-(vL-vH)-Myc-BBz-P2A-PDL2 | 3456 | 9342 |
| CD8SP-FMC63-(vL-vH)-Myc-BBz-P2A-MC159 | 3457 | 9343 |
| CD8SP-FMC63-(vL-vH)-Myc-BBz-P2A-crmA | 3458 | 9344 |
| CD8SP-FMC63-(vL-vH)-Myc-BBz-P2A-p35 | 3459 | 9345 |
| CD20 epitope | | 11787 |
| CD20 epitope | | 11788 |
| CD20 epitope | | 11789 |
| CD20 epitope | | 11790 |
| CD20 epitope | | 11791 |
| CD20 epitope | | 11792 |
| BCMA epitope | | 11793 |
| BCMA epitope | | 11794 |
| BCMA epitope | | 11795 |
| BCMA epitope | | 11796 |
| BCMA epitope | | 11797 |
| MPL epitope | | 11798 |
| CD24 GPI | | 11800 |
| CNTN1 GPI | | 11801 |
| EFNA1 GPI | | 11802 |
| EFNA2 GPI | | 11803 |
| EFNA3 GPI | | 11804 |
| EFNA4 GPI | | 11805 |
| FOLI GPI | | 11806 |
| LSAMP GPI | | 11807 |
| PPBI GPI | | 11808 |
| RTN4R GPI | | 11809 |
| CD8SP-FMC63-(vL-vH)-Myc-BBz-T2A-PAC | 12215 | 12228 |
| CD8SP-FMC63-vL-PG4SP-v2-[hTCRb-KACIAH]-F-P2A-SP-FMC63-vH-PG4SP-[hTCRa-CSDVP]-F-F2A-PAC | 12216 | 12229 |
| CD8SP-CD19-hu-mROO5-1-(vL-vH)-Myc-BBz-T2A-PAC | 12217 | 12230 |
| CD8SP-CD19-hu-mROO5-1-(vL-vH)-CD3e-ECDTMCP-opt2-F2A-PAC | 12218 | 12231 |
| CD8SP-CD19-hu-mROO5-1-(vL-vH)-CD3d-ECDTMCP-opt2-F2A-PAC | 12219 | 12232 |
| CD8SP-CD19-hu-mROO5-vL-[hTCRb-KACIAH]-F-P2A-SP-CD19-hu-mROO5-vH-[hTCRa-CSDVP]-F-F2A-PAC | 12220 | 12233 |
| CD8SP-2-CD19MM-(vL-vH)-Myc-BBz-T2A-PAC | 12221 | 12234 |
| CD8SP-2-CD19MM-(vL-vH)-CD3e-ECDTMCP-opt2-F-F2A-PAC | 12222 | 12235 |
| CD8SP-2-CD19MM-(vL-vH)-CD3d-ECDTMCP-opt2-F-F2A-PAC | 12223 | 12236 |
| CD8SP-FMC63-(vL-vH)-Myc-BBz-xba-GGS-xho-GGG-FKBP 12-F36V-Spe-F-P3A-Nde-PAC | 12224 | 12237 |

As described herein the disclosure provides methods and composition to prevent the accidental insertion of CAR (or similar construct) into a cancer cell.

Figure 1B:
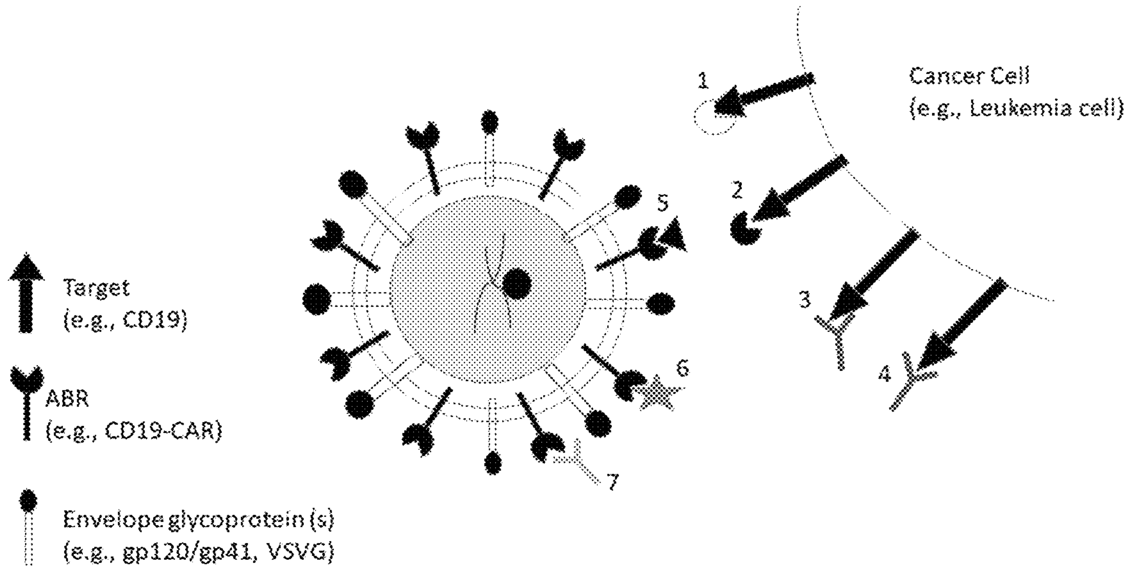

The disclosure offers a solution to the problem of accidental insertion of antigen binding receptors (ABRs) (e.g., a CAR, TFP, TAC etc.) into cancer cells. The disclosure is based on the discovery that ABR (e.g., a CAR, TFP, TAC etc.) polypeptides get inserted into the envelope of lentiviral vectors when the lentivirus is being produced in the producer cell line (e.g., 293FT cells). For example, a CD19-CAR polypeptide can be expressed by the producer cell line and translocated to the cellular membrane, where upon budding of the lentiviral vectors the CD19-CAR gets inserted into the envelope of a lentivirus containing the CD19 CAR polynucleotide (FIG. 1A). The resulting lentivirus can then enter the target cells through two mechanisms: (1) via the fusion of the envelop protein (e.g., VSVG envelop glycoprotein in case of VSVG pseudotyped virus) to its receptor and (2) via attachment of the antigen binding receptor (ABR) polypeptide to its target antigen (e.g., CD19 in case of a CD19 targeted CAR polypeptide) (FIG. 1A). In the case of T cells, only the first mechanism is operative (FIG. 1A). However, in case of a cancer cell, e.g., a leukemia cell or lymphoma cell; e.g., a CD19-expressing leuekemia or lymphoma cell, both the mechanisms are at play, resulting in preferential insertion of CAR construct into cancer cells (e.g., leukemia cells or lymphoma cells) (FIG. 1A). The disclosure provides methods and compositions to inhibit the accidental insertion of a ABR (e.g., a CAR, TFP, TAC etc.) into a cell, e.g., a cancer cell, by including an agent, such as an antibody, an antibody fragment, a vHH domain, a non-immunoglobulin antigen binding domain, a soluble receptor, or Protein L or a fragment thereof, that blocks the interaction of the antigen binding domain of the recombinant antigen binding receptor polypeptide (e.g., CAR polypeptide, e.g., CD19 scFV fragment comprising the CD19 CAR) with the antigen (e.g., CD19) being targeted by the ABR (e.g., a CAR, TFP, TAC etc.) (FIG. 1B). In one embodiment, the accidental insertion of a ABR (e.g., a CAR, TFP, TAC etc.) into any cell (e.g., a cancer cell) can be reduced by including an antigen binding agent that binds to the target antigen of the ABR (e.g., a CAR, TFP, TAC etc.) expressed on that cell (e.g., cancer cell). In one embodiment, the antigen binding agent is selected from the group of but not limited to a (1) an antibody; (2) an antibody fragment (e.g. a Fv, a Fab, a (Fab')2); (3) a heavy chain variable region of an antibody (vH domain) or a fragment thereof; (4) a light chain variable region of an antibody (vL domain) or a fragment thereof; (5) a single chain variable fragment (scFv) or a fragment thereof; (6) a single domain antibody (SDAB) or a fragment thereof; (7) a camelid VHH domain or a fragment thereof; (8) a monomeric variable region of an antibody; (9) a non-immunoglobulin antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) any other antigen-binding agent that can block the interaction of the ABR (e.g., a CAR, TFP etc.) with the target antigen.

In an embodiment, the antigen binding domain of the antigen binding agent binds to the same epitope on the target antigen as the antigen binding domain of the ABR (e.g., a CAR, TFP, TAC etc.). In another embodiment, the antigen binding domain of the antigen binding agent binds to an overlapping epitope on the target antigen as the antigen binding domain of the ABR (e.g., a CAR, TFP, TAC etc.). In yet another embodiment, the antigen binding domain of the antigen binding agent binds to a different epitope on the target antigen as the antigen binding domain of the ABR (e.g., a CAR, TFP, TAC etc.) but interferes with the binding of the ABR (e.g., a CAR, TFP, TAC etc.) to the target antigen.

In an embodiment, the antigen binding domain of the antigen binding agent is identical in sequence to the antigen binding domain of the ABR (e.g., a CAR, TFP, TAC etc.). In another embodiment, the antigen binding domain of the antigen binding agent is similar in sequence to the antigen binding domain of the ABR (e.g., a CAR, TFP etc.). In still another embodiment, the amino acid sequence encoding the antigen binding domain of the antigen binding agent has more than 80%, 85%, 90%, 95%, or 98% sequence homology to the amino acid sequence encoding antigen binding domain of the ABR (e.g., a CAR, TFP etc.).

In one embodiment, the one or more light chain and heavy chain CDRs of the antibody or antibody fragment encoding the antigen binding domain of the antigen binding agent are identical in amino acid sequence to the light chain and heavy chain CDRs of antigen binding domain of the ABR (e.g., a CAR, TFP etc.). In another embodiment, one or more light chain and heavy chain CDRs of the antibody or antibody fragment encoding the antigen binding domain of the antigen binding agent are homologous in amino acid sequence to the one or more light chain and heavy chain CDRs of antigen binding domain of the ABR (e.g., a CAR, TFP etc.). In still another embodiment, one or more light chain and heavy chain CDRs of the antibody or antibody fragment encoding the antigen binding domain of the antigen binding agent have more than 80%, 85%, 90%, 95%, or 98% sequence homology to the amino acid sequence of the one or more light chain and heavy chain CDRs of antigen binding domain of the ABR (e.g., a CAR, TFP etc.).

The antibody, antibody fragments, vHH, single domain antibodies and non-immunoglobulin antigen binding domains (e.g., centyrin) that can be used to reduce the accidental insertion of a ABR (e.g., a CAR, TFP etc.) into cancer cells can be identified by one with ordinary skill in the art based on the information about the antigen binding domain of the ABR (e.g., a CAR, TFP etc.). In an exemplary embodiment, if the antigen binding domain of a CD19 CAR comprises an scFv fragment derived from FMC63 monoclonal antibody or its humanized variant, then the FMC63 monoclonal antibody can be used in the method of the disclosure to reduce the accidental insertion of the FMC63 scFv containing CD19 CAR into CD19-expressing leukemia cells.

In another embodiment, the agent that interferes with the binding of the ABR (e.g., a CAR, TFP etc.) to the target antigen is soluble form of the target antigen or a fragment or a variant thereof provided that it retains the ability to bind to the ABR (e.g., a CAR, TFP etc.). In still another embodiment, the soluble form of the target antigen is soluble form of a receptor (e.g., soluble form of MPL, e.g. SEQ ID NO: 6022 or soluble form of CD19 comprising its extracellular domain). In yet another embodiment, the soluble form of the target antigen is an Fc chimera (e.g., CD19-Fc). In still another embodiment, the soluble form of the target antigen comprises a sequence that is identical or has more than 80%, 85%, 90%, 95% or 98% homology at the amino acid level to the target antigen. In another embodiment, the soluble form of the target antigen comprises an epitope that is bound by the ABR (e.g., a CAR, TFP etc). In one embodiment, the soluble form of the target antigen comprises an epitope that is identical in amino acid sequence or has more than 80%, 85%, 90%, 95% or 98% homology at the amino acid level to amino acid sequence of the epitope bound by the ABR (e.g., a CAR, TFP etc.). The SEQ ID Nos of the exemplary soluble forms of several antigens containing their extracellular domains are provided in Table 9. The SEQ ID Nos of the exemplary soluble forms of several antigens containing their extracellular domains in fusion with an optional Luciferase module (Luc) are provided in Table 10. These constructs also carry a puromycin resistance gene (PAC), which is optional and not needed for the functionality of the soluble proteins. Thus, both the Luc and PAC modules can be deleted without compromising the functionality of the proteins to compete with the target antigen of the ABR.

The dose of the agent that can be used to prevent the accidental insertion of the ABR (e.g., a CAR, TFP etc.) into cancer cells can be determined by titration experiments using methods known in the art. In one embodiment, the agent is used at a concentration to compete out the ABR (e.g., a CAR, TFP etc.) for binding to the target antigen. In another embodiment, the agent is used at a concentration of about 1 ng/ml, 10 ng/ml, 50 ng/ml, 100 ng/ml, 200 ng/ml, 500 ng/ml, 1 μg/ml, 2 μg/ml, 5 μg/ml, 10 μg/ml or 50 μg/ml.

In another embodiment, the viral vector encoding the ABR (e.g., a CAR, TFP etc.) is contacted with the agent prior to the contact with the target cells (e.g., T cells or cancer cell contaminating the T cell preparation). In still another embodiment, the viral vector encoding the ABR (e.g., a CAR, TFP etc.) is contacted with the agent during the period of contact with the target cells (e.g., T cells or cancer cell contaminating the T cell preparation). In another embodiment, the viral vector encoding the ABR (e.g., a CAR, TFP etc.) is contacted with the agent both prior to and during the period of contact with the target cells (e.g., T cells or cancer cell contaminating the T cell preparation).

In another embodiment, the viral vector encoding the ABR (e.g., a CAR, TFP etc.) is contacted with the agent for a time period of more than 1 min (e.g., 2 min, 5 min, 10 min, 30 min, 60 min, 2 hours etc.) prior to the contact with the target cells (e.g., T cells or cancer cell contaminating the T cell preparation). In still another embodiment, the viral vector encoding the ABR (e.g., a CAR, TFP etc.) is contacted with the agent for a period of time of more than 1 min (e.g., 2 min, 5 min, 10 min, 30 min, 60 min, 2 hours etc.) during the period of contact with the target cells (e.g., T cells or cancer cell contaminating the T cell preparation). In yet another embodiment, the viral vector encoding the ABR (e.g., a CAR, TFP etc.) is contacted with the agent for a period of time of more than 1 min (e.g., 2 min, 5 min, 10 min, 30 min, 60 min, 2 hours etc.) both prior to and during the period of contact with the target cells (e.g., T cells or cancer cell contaminating the T cell preparation).

In yet another embodiment, the viral vector encoding the ABR (e.g., a CAR, TFP etc.) is contacted with the agent in the presence of culture media and additives. In still another embodiment, the viral vector encoding the ABR (e.g., a CAR, TFP etc.) is contacted with the agent in the presence of other agents that enhance viral vector transduction into the target cells. Non-limiting examples of such agents include polybrene and retronectin.

In one exemplary embodiment, the accidental insertion of a CD19-targeted CAR (e.g., SEQ ID NO: 1455 to 1461) or TFP or TAC into CD19 expressing leukemia or lymphoma cells during CAR-T cell manufacturing can be reduced by inclusion of a CD19 binding agent before and/or during the step of infection with the CAR encoding virus. In various embodiments the CD19 binding agent is selected from the group of but not limited to a (1) a CD19 antibody (e.g., FMC63 antibody); (2) a CD19 antibody fragment (e.g. a Fv, a Fab, a (Fab')2); (3) a heavy chain variable region of a CD19 antibody (vH domain) or a fragment thereof; (4) a light chain variable region of a CD19 antibody (vL domain) or a fragment thereof; (5) a CD19 single chain variable fragment (scFv) or a fragment thereof; (6) a single domain CD19 antibody (SDAB) or a fragment thereof; (7) a camelid CD19 VHH domain or a fragment thereof; (8) a monomeric variable region of a CD19 antibody; (9) a non-immunoglobulin CD19 antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) any other CD19-binding molecule.

In another exemplary embodiment, the accidental insertion of a CD19-targeted ABR (e.g., a CAR, TFP, TAC etc.) into CD19 expressing cancer cells can be reduced by inclusion of an agent that competes with or interferes with the binding of the CAR to the CD19 antigen (e.g., soluble CD19 receptor (e.g., SEQ ID NO: 6047, or Recombinant Human CD19 Fc Chimera Protein; Novus Biological, Cat #9269-CD-050), an anti-idiotype antibody, Protein L, or a fragment thereof) before or during the step of infection with the CAR encoding virus. In an exemplary embodiment, the soluble C19 receptor (e.g., CD19 extracellular domain or Recombinant Human CD19 Fc Chimera Protein) can be preincubated with the lentivirus particles encoding the CD19 encoding CAR prior to infection of target cells with the lentivirus. In some embodiments, the soluble CD19 receptor comprises the extracellular domain of CD19 (e.g., SEQ ID NO: 6021) or variant thereof that retains the ability to compete with CD19 for binding to the CD19 targeted CAR or ABR. In other embodiment, the soluble CD19 receptor comprises of the region or the epitope of the CD19 extracellular domain that is bound by the CAR. The region or the epitope of the CD19 extracellular domain that is bound by the CAR can be determined by methods known in the art, such as deletion mutagenesis.

In another embodiment, Protein L or a fragment of Protein L that binds to κ light chains of an antibody can be used to disrupt the interaction of the scFv fragment of the ABR (e.g., a CAR) with the CAR target. In an exemplary embodiment, Protein L or a fragment of Protein L that binds to κ light chains of an antibody can be incubated with the lentivirus particles encoding the CD19 CAR before and/or during the infection of the target cells with the lentivirus.

In another embodiment, an anti-idiotype antibody that binds to the scFv region of an ABR (e.g. CAR, TFP, TAC etc.) can be used to disrupt the interaction of the ABR with its target antigen. In an exemplary embodiment, a FMC63 anti-idiotype antibody or antibody fragment (e.g., SEQ ID NO: 6090) can be incubated with the lentivirus particles encoding the FMC63 based CD19 CAR before and during infection of the target cells with the lentivirus. An FMC63 anti-idiotype antibody is described by Jena, B. et al (PLoS One, 8, e57838). An scFv fragment containing the vL and vH fragments of this antibody are presented in SEQ ID NO: 6090.

In one embodiment, an antigen binding agent against CD19 is an antigen binding portion, e.g., CDRs, of vL and vH fragments targeting this antigen or of an antibody described in, e.g., U.S. Pat. Nos. 8,323,653, 7,112,324, 8,624,001 or U.S. Pat. No. 7,109,304, or PCT Publication No. WO 2009/052431 A2, WO 2010/095031 A2, or WO 2014153270. In one embodiment, an antigen binding agent against CD19 is an antibody, an antibody fragment or an antibody-like moiety described in, e.g., U.S. Pat. Nos. 8,323,653, 7,112,324, 8,624,001 or U.S. Pat. No. 7,109,304, or PCT Publication No. WO 2009/052431 A2, WO 2010/095031 A2, or WO 2014153270.

In yet another embodiment, the accidental insertion of a ABR (e.g., a CAR, TFP etc.) into a cancer cells can be reduced by expressing the target of the ABR (e.g., a CAR, TFP etc.) in the packaging cells that are used to generate the viral vector encoding the ABR (e.g., a CAR, TFP etc.). In an exemplary embodiment, the accidental insertion of a CD19-CAR into CD19 expressing cancer cells can be reduced by coexpressing the CD19 receptor (SEQ ID NO: 59) or a fragment of CD19 receptor targeted by the CD19-CAR (e.g., SEQ ID NO: 67) in the packaging cell lines that are used to produce the CD19-CAR so that the CD19 CAR expressed on the surface of the viral particles is bound by the CD19 receptor that is also co-expressed on the surface of the viral particles. In an exemplary embodiment, the accidental insertion of a CD19-CAR into CD19 expressing cancer cells can be reduced by coexpressing the membrane anchored form of Protein L (DNA SEQ ID NO:1954 and PRT SEQ ID NO:7840) or membrane anchored form of an anti-idiotype antibody (DNA SEQ ID NO: 1704 and PRT SEQ ID NO: 7590) targeting the scFv region of the CD19-CAR in the packaging cell lines that are used to produce the CD19-CAR so that the CD19 CAR expressed on the surface of the viral particles is bound by the Protein L or the anti-idiotype antibody that is also co-expressed on the surface of the viral particles. In yet another embodiment, the accidental insertion of a ABR (e.g., a CAR, TFP etc.) into a cancer cells can be reduced by reducing or eliminating the expression of the ABR (e.g., a CAR, TFP etc.) on the surface of the packaging cells that are used to generate the ABR (e.g., a CAR, TFP etc.) encoding vector. In yet another embodiment, the accidental insertion of a ABR (e.g., a CAR, TFP etc.) into a cancer cells can be reduced by reducing or eliminating the expression of the ABR (e.g., a CAR, TFP etc.) on envelop of the viral vector encoding the ABR (e.g., a CAR, TFP etc.). In an exemplary embodiment, the expression of ABR (e.g., a CAR, TFP etc.) on the surface of the packaging cells or viral envelop can be reduced by controlling its expression at the transcriptional, post-transcriptional, translational or post-translational steps. In an exemplary embodiment, the expression of ABR (e.g., a CAR, TFP etc.) on the surface of the packaging cells or viral envelop can be reduced by inducing degradation of ABR (e.g., a CAR, TFP etc.) polypeptide using techniques known in the art, such as the dTAG system for selective protein degradation. In some embodiments, the ABR (e.g., a CAR, TFP etc.) encoding virus is a virus, e.g., a lentivirus, a γ retrovirus, an adenovirus or an adeno-associated virus.

The methods and compositions of the disclosure are not limited to CD19 CAR manufacturing. The methods of the disclosure can be used to prevent the accidental insertion of any ABR (e.g., a CAR, TFP etc.) where the ABR gets inserted into the envelop of the lentiviral vector and/or where the ABR-encoding lentiviral vector shows preferential binding and infection of cancer cells expressing the cognate antigen of the ABR. In an exemplary embodiment, the accidental insertion of an ABR (e.g., a CAR, TFP etc.) into cancer cells can be reduced by reducing or eliminating the expression of the ABR (e.g., a CAR, TFP etc.) on the envelop of the viral vector encoding the ABR (e.g., a CAR, TFP etc.) or by interfering with the binding of the ABR (e.g., a CAR, TFP etc.) to its target antigen expressed on the cancer cells. In an exemplary embodiment, the accidental insertion of an ABR (e.g., a CAR, TFP etc.) into cancer cells (e.g., leukemia cells) can be reduced by inclusion of an ABR (e.g., a CAR, TFP etc.) target binding agent (e.g., an antibody or scFv) or an agent that interferes with the binding of the ABR (e.g., a CAR, TFP etc.) to its antigen (e.g., soluble receptor encoding the target antigen of the ABR (e.g., a CAR, TFP etc.) or a fragment of the target antigen that is bound by the ABR) before and/or during the step of infection with the ABR (e.g., a CAR, TFP etc.) encoding-virus. In another exemplary embodiment, the accidental insertion of an ABR (e.g., a CAR, TFP etc.) into cancer cells (e.g., leukemia cells) can be reduced by co-expressing the membrane anchored form of the target antigen or the fragment of the target antigen targeted by the ABR (e.g., a CAR, TFP etc.) in the packaging cells and/or on the envelop of the viral vector encoding the ABR (e.g., a CAR, TFP etc.). In another exemplary embodiment, the accidental insertion of an ABR (e.g., a CAR, TFP etc.) into cancer cells (e.g., leukemia cells) can be reduced by reducing or eliminating the expression of ABR (e.g., a CAR, TFP etc.) in the packaging cells and/or on the envelop of the viral vector encoding the ABR (e.g., a CAR, TFP etc.).

The methods and compositions of the disclosure can be used to reduce the accidental insertion of any ABR (e.g., a CAR, TFP, TAC etc.) into cancer cells where the ABR (e.g., a CAR, TFP etc.) encoding retroviral vector shows preferential infection of the cancer cells and targets one or more of the antigens selected from but not limited to the following: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bDGa1p(1-4)bDG1cp(1-1) Cer); TNF receptor family member B cell maturation (BCMA); Tn antigen ((Tn Ag) or (Ga1NAcα-Ser/Thr)); prostate-specific membrane antigen (PSMA); Receptor tyrosine kinase-like orphan receptor 1 (ROR1); FmsLike Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDCla1p(1-4)bDG1cp(1-1)Cer); transglutaminase 5 (TGS5); high molecular weight-melanomaassociated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPlB 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCR-gamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel and Integrin B7.

The methods and compositions of the disclosure can be used to prevent the accidental insertion of the ABR (e.g., a CAR, TFP etc.) into any cell, including cancer cells and healthy normal cells (e.g., T cells or stem cells). In one embodiment, the cancer is a blood cancer (e.g., leukemia, lymphoma, myeloma etc.). In an embodiment, the cancer is a solid organ derived cancer (e.g., breast cancer, lung cancer, prostate cancer, colon cancer, brain cancer etc.)

The nucleic acid SEQ ID NOs of exemplary scFv that can be used to prevent the accidental insertion of the corresponding ABR (e.g., a CAR, TFP etc.) are provided in Table 7 (SEQ ID NO: 205-453). The corresponding amino acid sequences are provided in SEQ ID NO: 6091-6339. The sequence of these scFv can be also used to generate antibody and antibody fragments (e.g., a Fv, a Fab, a (Fab')2) using recombinant DNA techniques known in the art. Such antibodies and antibody fragments (e.g., Fab) can be used to prevent the accidental insertion of the corresponding ABRs. The scFv, antibody, antibody fragment or the non-immunoglobulin antigen binding domains can be further affinity optimized so as to enhance their ability to compete with the ABR (e.g., a CAR, TFP etc.) for binding to the target antigen.

The nucleic acid SEQ ID NOs of exemplary second generation CARs containing 41BB costimulatory domain and CD3z activation domain are provided in Table 8 (SEQ ID NO: 1455-1703). The corresponding amino acid sequences are provided in SEQ ID NO: 7341-7589. The target antigens of these CAR constructs can be determined by reference to Table 7 as the order of these CARs and their target antigens is same as the order of the scFvs and their target antigens shown in Table 7. The method, however, is not limited to 2$^{nd}$ generation CARs containing 41BB costimulatory domain. In an embodiment, the method can be used in case of any chimeric receptor or recombinant receptor that can be expressed in the packaging cells and/or gets incorporated into the envelop of the viral vector. In an embodiment, the method can be used in case of any chimeric receptor or recombinant receptor that can be expressed in the packaging cells and/or gets incorporated into the envelop of the viral vector and has an antigen binding domain. Exemplary chimeric receptors whose accidental insertion can be reduced by the method of the disclosure include first generation CARs, 2$^{nd}$ generation CARs containing CD28 costimulatory domain, 3$^{rd}$ generation CARs containing two or more costimulatory domains, TFPs and Tri-TAC (TAC) etc. The inventor has further discovered that the problem of accidental insertion of ABR-encoding lentiviral vectors into cancer cells is not seen with SIR, cTCR, Ab-TCR, αβTFP and γδTFP.

In another exemplary embodiment, the accidental insertion of a BCMA-targeted CAR into BCMA expressing myeloma or primary effusion lymphoma cells during CAR-T cell manufacturing can be reduced by inclusion of a BCMA binding agent before and/or during the step of infection with the CAR encoding virus. In various embodiments, the BCMA binding agent is selected from the group consisting of, but not limited to, (1) an antibody; (2) an antibody fragment (e.g. a Fv, a Fab, a (Fab')2); (3) a heavy chain variable region of an antibody (vH domain) or a fragment thereof; (4) a light chain variable region of an antibody (vL domain) or a fragment thereof; (5) a single chain variable fragment (scFv) or a fragment thereof; (6) a single domain antibody (SDAB) or a fragment thereof; (7) a camelid VHH domain or a fragment thereof; (8) a monomeric variable region of an antibody; (9) a non-immunoglobulin antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) a receptor (e.g., nucleic acid SEQ ID NO: 156 and amino acid SEQ ID NO: 6042); and (11) a ligand.

In one embodiment, an antigen binding agent against BCMA is an antigen binding portion, e.g., CDRs, of vL and vH fragments targeting this antigen or of an antibody described in, e.g., WO2016090327, WO2015052538, WO2012163805, WO200112812, or WO2003062401. In one embodiment, an antigen binding agent against BCMA is an antibody, an antibody fragment or an antibody-like moiety described in, e.g., WO2016090327, WO2015052538, WO2012163805, WO200112812, or WO2003062401.

In another exemplary embodiment, the accidental insertion of a BCMA-CAR into BCMA expressing cancer cells (e.g., myeloma or PEL cells) can be reduced by reducing or eliminating the expression or presence of BCMA CAR on the envelop of the viral vector encoding the BCMA CAR or by interfering with the binding of the BCMA CAR to the BCMA antigen expressed on the cancer cells. In an exemplary embodiment, the accidental insertion of a BCMA-CAR into BCMA expressing cancer cells (e.g., leukemia cells) can be reduced by inclusion of a BCMA binding agent (e.g., a BCMA antibody or BCMA scFv) or an agent that interferes with the binding of the CAR to the BCMA antigen (e.g., soluble BCMA receptor (e.g., SEQ ID NO: 6042, e.g., BCMA-ECD-Fc or BCMA-ECD or a fragment of BCMA extracellular domain) before and/or during the step of infection with the CAR encoding virus. In another exemplary embodiment, the accidental insertion of a BCMA-CAR into BCMA expressing cancer cells (e.g., leukemia cells) can be reduced by co-expressing the membrane anchored form of BCMA receptor (e.g., SEQ ID NO: 68) or its epitope targeted by the BCMA CAR, or Membrane anchored form of Protein L or membrane anchored form of an anti-idiotype antibody targeting the scFv region of the BCMA CAR in the packaging cells and/or on the envelop of the viral vector encoding the CAR. In another exemplary embodiment, the accidental insertion of a BCMA-CAR into BCMA expressing cancer cells (e.g., leukemia cells) can be reduced by reducing or eliminating the expression of BCMA CAR in the packaging cells and/or on the envelop of the viral vector encoding the BCMA CAR.

In another exemplary embodiment, the accidental insertion of a SLAMF7/CS1-CAR into SLAMF7/CS1 expressing cancer cells (e.g., myeloma cells or PEL cells) can be reduced by reducing or eliminating the expression of SLAMF7/CS1 CAR on the envelop of the viral vector encoding the SLAMF7/CS1 CAR or by interfering with the binding of the SLAMF7/CS1 CAR to the SLAMF7/CS1 antigen expressed on the cancer cells. In an exemplary embodiment, the accidental insertion of a SLAMF7/CS1-CAR into SLAMF7/CS1 expressing cancer cells (e.g., leukemia cells) can be reduced by inclusion of a SLAMF7/CS1 binding agent (e.g., a SLAMF7/CS1 antibody or SLAMF7/CS1 scFv) or an agent that interferes with the binding of the CAR to the SLAMF7/CS1 antigen (e.g., soluble SLAMF7/CS1 receptor, e.g., SLAMF7/CS1-ECD-Fc or SLAMF7/CS1-ECD or a fragment of SLAMF7/CS1 extracellular domain) before and/or during the step of infection with the CAR encoding virus.

In some embodiments, an antigen binding agent against CS1 is an antigen binding portion of an antibody described in US 2005/0025763 A1 or U.S. Pat. No. 8,603,477 B2. In some embodiments, an antigen binding agent against CS1 is an antibody, an antibody fragment or an antibody-like moiety described in, e.g., US 2005/0025763 A1 or U.S. Pat. No. 8,603,477 B2.

In another exemplary embodiment, the accidental insertion of a SLAMF7/CS1-CAR into SLAMF7/CS1 expressing cancer cells (e.g., leukemia cells) can be reduced by co-expressing the membrane anchored form of SLAMF7/CS1 receptor or its epitope targeted by the SLAMF7/CS1 CAR, or membrane anchored form of Protein L or membrane anchored form of an anti-idiotype antibody targeting the scFv region of the SLAMF7/CS1CAR in the packaging cells and/or on the envelop of the viral vector encoding the CAR. In another exemplary embodiment, the accidental insertion of a SLAMF7/CS1-CAR into SLAMF7/CS1 expressing cancer cells (e.g., leukemia cells) can be reduced by reducing or eliminating the expression of SLAMF7/CS1 CAR in the packaging cells and/or on the envelop of the viral vector encoding the SLAMF7/CS1 CAR.

In another exemplary embodiment, the accidental insertion of a CD38-CAR into CD38 expressing cancer cells (e.g., myeloma or PEL cells) can be reduced by reducing or eliminating the expression of CD38 CAR on the envelop of the viral vector encoding the CD38 CAR or by interfering with the binding of the CD38 CAR to the CD38 antigen expressed on the cancer cells. In an exemplary embodiment, the accidental insertion of a CD38-CAR into CD38 expressing cancer cells (e.g., leukemia cells) can be reduced by inclusion of a CD38 binding agent (e.g., a CD38 antibody or CD38 scF) or an agent that interferes with the binding of the CAR to the CD38 antigen (e.g., soluble CD38 receptor, e.g., CD38-ECD-Fc or CD38-ECD or a fragment of CD38 extracellular domain) before and/or during the step of infection with the CAR encoding virus. In one embodiment, an antigen binding agent against CD38 is an antigen binding portion, e.g., CDRs, of vL and vH fragments targeting this antigen or of an antibody daratumumab (see, e.g., Groen et al., Blood 116(21):1261-1262 (2010); MOR202 (see, e.g., U.S. Pat. No. 8,263,746); or antibodies described in U.S. Pat. No. 8,362,211. In one embodiment, an antigen binding agent against CD38 is an antibody, an antibody fragment or an antibody-like moiety described in, e.g., Groen et al., Blood 116(21):1261-1262 (2010); MOR202 (see, e.g., U.S. Pat. No. 8,263,746); or antibodies described in U.S. Pat. No. 8,362,211. In another exemplary embodiment, the accidental insertion of a CD38-CAR into CD38 expressing cancer cells (e.g., leukemia cells) can be reduced by co-expressing the membrane anchored form of CD38 receptor or its epitope targeted by the CD38 CAR, or Membrane anchored form of Protein L or membrane anchored form of an anti-idiotype antibody targeting the scFv region of the CD38 CAR in the packaging cells and/or on the envelop of the viral vector encoding the CAR. In another exemplary embodiment, the accidental insertion of a CD38-CAR into CD38 expressing cancer cells (e.g., leukemia cells) can be reduced by reducing or eliminating the expression of CD38 CAR in the packaging cells and/or on the envelop of the viral vector encoding the CD38 CAR.

In another exemplary embodiment, the accidental insertion of a CD138-CAR into CD138 expressing cancer cells (e.g., myeloma or PEL cells) can be reduced by reducing or eliminating the expression of CD138 CAR on the envelop of the viral vector encoding the CD138 CAR or by interfering with the binding of the CD138 CAR to the CD138 antigen expressed on the cancer cells. In an exemplary embodiment, the accidental insertion of a CD138-CAR into CD138 expressing cancer cells (e.g., leukemia cells) can be reduced by inclusion of a CD138 binding agent (e.g., a CD138 antibody or CD138 scFv) or an agent that interferes with the binding of the CAR to the CD138 antigen (e.g., soluble CD138 receptor, e.g., CD138-ECD-Fc or CD138-ECD or a fragment of CD138 extracellular domain) before and/or during the step of infection with the CAR encoding virus. In one embodiment, an antigen binding agent against CD138 is an antigen binding portion, e.g., CDRs, of vL and vH fragments targeting this antigen or of an antibody, e.g., an antibody described in, WO2014089354 or US20150010585. In one embodiment, an antigen binding agent against CD138 is an antibody, an antibody fragment or an antibody-like moiety described in, e.g., WO2014089354 or US20150010585.

In another exemplary embodiment, the accidental insertion of a CD138-CAR into CD138 expressing cancer cells (e.g., leukemia cells) can be reduced by co-expressing the membrane anchored form of CD138 receptor or its epitope targeted by the CD138 CAR, or Membrane anchored form of Protein L or membrane anchored form of an anti-idiotype antibody targeting the scFv region of the CD138 CAR in the packaging cells and/or on the envelop of the viral vector encoding the CAR. In another exemplary embodiment, the accidental insertion of a CD138-CAR into CD138 expressing cancer cells (e.g., leukemia cells) can be reduced by reducing or eliminating the expression of CD138 CAR in the packaging cells and/or on the envelop of the viral vector encoding the CD138 CAR.

In another exemplary embodiment, the accidental insertion of a CD123-CAR into CD123 expressing cancer cells (e.g., leukemia cells) can be reduced by reducing or eliminating the expression of CD123 CAR on the envelop of the viral vector encoding the CD123 CAR or by interfering with the binding of the CD123 CAR to the CD123 antigen expressed on the cancer cells. In an exemplary embodiment, the accidental insertion of a CD123-CAR into CD123 expressing cancer cells (e.g., leukemia cells) can be reduced by inclusion of a CD123 binding agent (e.g., a CD123 antibody or CD123 scFv) or an agent that interferes with the binding of the CAR to the CD123 antigen (e.g., soluble CD123 receptor, e.g., CD123-ECD-Fc or CD123-ECD or a fragment of CD123 extracellular domain) before and/or during the step of infection with the CAR encoding virus. In one embodiment, an antigen binding agent against CD123 is an antigen binding portion, e.g., CDRs, of vL and vH fragments targeting this antigen or of an antibody, e.g., an antibody described in, U.S. Pat. No. 8,569,461, WO2015044386 or US20140322212. In one embodiment, an antigen binding agent against CD123 is an antibody, an antibody fragment or an antibody-like moiety described in, e.g., U.S. Pat. No. 8,569,461, WO2015044386 or US20140322212. In another exemplary embodiment, the accidental insertion of a CD123-CAR into CD123 expressing cancer cells (e.g., leukemia cells) can be reduced by co-expressing the membrane anchored form of CD123 receptor or its epitope targeted by the CD123 CAR, or Membrane anchored form of Protein L or membrane anchored form of an anti-idiotype antibody targeting the scFv region of the CD123 CAR in the packaging cells and/or on the envelop of the viral vector encoding the CAR. In another exemplary embodiment, the accidental insertion of a CD123-CAR into CD123 expressing cancer cells (e.g., leukemia cells) can be reduced by reducing or eliminating the expression of CD123 CAR in the packaging cells and/or on the envelop of the viral vector encoding the CD123 CAR.

In another exemplary embodiment, the accidental insertion of a CD33-CAR into CD33 expressing cancer cells (e.g., leukemia cells) can be reduced by reducing or eliminating the expression of CD33 CAR on the envelop of the viral vector encoding the CD33 CAR or by interfering with the binding of the CD33 CAR to the CD33 antigen expressed on the cancer cells. In an exemplary embodiment, the accidental insertion of a CD33-CAR into CD33 expressing cancer cells (e.g., leukemia cells) can be reduced by inclusion of a CD33 binding agent (e.g., a CD33 antibody or CD33 scFv) or an agent that interferes with the binding of the CAR to the CD33 antigen (e.g., soluble CD33 receptor, e.g., CD33-ECD-Fc or CD33-ECD or a fragment of CD33 extracellular domain) before and/or during the step of infection with the CAR encoding virus.

In one embodiment, an antigen binding agent against CD33 is an antigen binding portion, e.g., CDRs, of vL and vH fragments targeting this antigen or of an antibody, e.g., an antibody described in WO2012045752, WO2013173496, WO2016014576, WO2015089344, US20110275787, WO2012045752. In one embodiment, an antigen binding agent against CD33 is an antibody, an antibody fragment or an antibody-like moiety described in, e.g., WO2012045752, WO2013173496, WO2016014576, WO2015089344, US20110275787, and WO2012045752. In another exemplary embodiment, the accidental insertion of a CD33-CAR into CD33 expressing cancer cells (e.g., leukemia cells) can be reduced by co-expressing the membrane anchored form of CD33 receptor or its epitope targeted by the CD33 CAR, or Membrane anchored form of Protein L or membrane anchored form of an anti-idiotype antibody targeting the scFv region of the CD33 CAR in the packaging cells and/or on the envelop of the viral vector encoding the CAR. In another exemplary embodiment, the accidental insertion of a CD33-CAR into CD33 expressing cancer cells (e.g., leukemia cells) can be reduced by reducing or eliminating the expression of CD33 CAR in the packaging cells and/or on the envelop of the viral vector encoding the CD33 CAR.

In another exemplary embodiment, the accidental insertion of a CD22-CAR into CD22 expressing cancer cells (e.g., leukemia or lymphoma cells) can be reduced by reducing or eliminating the expression of CD22 CAR on the envelop of the viral vector encoding the CD22 CAR or by interfering with the binding of the CD22 CAR to the CD22 antigen expressed on the cancer cells. In an exemplary embodiment, the accidental insertion of a CD22-CAR into CD22 expressing cancer cells (e.g., leukemia cells) can be reduced by inclusion of a CD22 binding agent (e.g., a CD22 antibody or CD22 scFv) or an agent that interferes with the binding of the CAR to the CD22 antigen (e.g., soluble CD22 receptor, e.g., CD22-ECD-Fc or CD22-ECD or a fragment of CD22 extracellular domain) before and/or during the step of infection with the CAR encoding virus. In one embodiment, an antigen binding agent against CD22 is an antigen binding portion, e.g., CDRs, of vL and vH fragments targeting this antigen or of an antibody, e.g., an antibody described in U.S. Pat. No. 8,394,607 B2, U.S. Pat. No. 8,591,889 or PCT Publication No. WO 2007103469, WO 2012170785, WO2013059593 or European Patent Application EP 2 540 741 A1. In one embodiment, an antigen binding agent against CD22 is an antibody, an antibody fragment or an antibody-like moiety described in, e.g., U.S. Pat. No. 8,394,607 B2, U.S. Pat. No. 8,591,889 or PCT Publication No. WO 2007103469, WO 2012170785, WO2013059593 or European Patent Application EP 2 540 741 A1. In another exemplary embodiment, the accidental insertion of a CD22-CAR into CD22 expressing cancer cells (e.g., leukemia cells) can be reduced by co-expressing the membrane anchored form of CD22 receptor or its epitope targeted by the CD22 CAR, or Membrane anchored form of Protein L or membrane anchored form of an anti-idiotype antibody targeting the scFv region of the CD22 CAR in the packaging cells and/or on the envelop of the viral vector encoding the CAR. In another exemplary embodiment, the accidental insertion of a CD22-CAR into CD22 expressing cancer cells (e.g., leukemia cells) can be reduced by reducing or eliminating the expression of CD22 CAR in the packaging cells and/or on the envelop of the viral vector encoding the CD22 CAR.

In another exemplary embodiment, the accidental insertion of a CD20-CAR into CD20 expressing cancer cells (e.g., leukemia or lymphoma cells) can be reduced by reducing or eliminating the expression of CD20 CAR on the envelop of the viral vector encoding the CD20 CAR or by interfering with the binding of the CD20 CAR to the CD20 antigen expressed on the cancer cells. In an exemplary embodiment, the accidental insertion of a CD20-CAR into CD20 expressing cancer cells (e.g., leukemia cells) can be reduced by inclusion of a CD20 binding agent (e.g., a CD20 antibody or CD20 scFv) or an agent that interferes with the binding of the CAR to the CD20 antigen (e.g., soluble CD20 receptor, e.g., CD20-ECD-Fc or CD20-ECD or a fragment of CD20 extracellular domain) before and/or during the step of infection with the CAR encoding virus. In one embodiment, an antigen binding agent against CD20 is an antigen binding portion, e.g., CDRs, of vL and vH fragments targeting this antigen or of an antibody, e.g., Rituximab, Ofatumumab, Ocrelizumab, Veltuzumab, or GA101. In one embodiment, an antigen binding agent against CD20 is an antibody (Rituximab, Ofatumumab, Ocrelizumab, Veltuzumab, or GA101), an antibody fragment or an antibody-like moiety described in, e.g., WO2006084264, WO2004103404 or WO2014071125. In another exemplary embodiment, the accidental insertion of a CD20-CAR into CD20 expressing cancer cells (e.g., leukemia cells) can be reduced by co-expressing the membrane anchored form of CD20 receptor or its epitope targeted by the CD20 CAR, or Membrane anchored form of Protein L or membrane anchored form of an anti-idiotype antibody targeting the scFv region of the CD20 CAR in the packaging cells and/or on the envelop of the viral vector encoding the CAR. In another exemplary embodiment, the accidental insertion of a CD20-CAR into CD20 expressing cancer cells (e.g., leukemia cells) can be reduced by reducing or eliminating the expression of CD20 CAR in the packaging cells and/or on the envelop of the viral vector encoding the CD20 CAR.

In another exemplary embodiment, the accidental insertion of a CD30-CAR into CD30 expressing cancer cells (e.g., lymphoma cells) can be reduced by reducing or eliminating the expression of CD30 CAR on the envelop of the viral vector encoding the CD30 CAR or by interfering with the binding of the CD30 CAR to the CD30 antigen expressed on the cancer cells. In an exemplary embodiment, the accidental insertion of a CD30-CAR into CD30 expressing cancer cells (e.g., leukemia cells) can be reduced by inclusion of a CD30 binding agent (e.g., a CD30 antibody or CD30 scFv) or an agent that interferes with the binding of the CAR to the CD30 antigen (e.g., soluble CD30 receptor, e.g., CD30-ECD-Fc or CD30-ECD or a fragment of CD30 extracellular domain) before and/or during the step of infection with the CAR encoding virus. In one embodiment, an antigen binding agent against CD30 is an antigen binding portion, e.g., CDRs, of vL and vH fragments targeting this antigen or of an antibody, e.g., an antibody described in U.S. Pat. No. 7,090,843 B1, and EP0805871. In one embodiment, an antigen binding agent against CD30 is an antibody, an antibody fragment or an antibody-like moiety described in, e.g., U.S. Pat. No. 7,090,843 B1, and EP0805871. In another exemplary embodiment, the accidental insertion of a CD30-CAR into CD30 expressing cancer cells (e.g., leukemia cells) can be reduced by co-expressing the membrane anchored form of CD30 receptor or its epitope targeted by the CD30 CAR, or Membrane anchored form of Protein L or membrane anchored form of an anti-idiotype antibody targeting the scFv region of the CD30 CAR in the packaging cells and/or on the envelop of the viral vector encoding the CAR. In another exemplary embodiment, the accidental insertion of a CD30-CAR into CD30 expressing cancer cells (e.g., leukemia cells) can be reduced by reducing or eliminating the expression of CD30 CAR in the packaging cells and/or on the envelop of the viral vector encoding the CD30 CAR.

In another exemplary embodiment, the accidental insertion of a MPL-CAR into MPL expressing cancer cells (e.g., leukemia cells) can be reduced by reducing or eliminating the expression of MPL CAR on the envelop of the viral vector encoding the MPL CAR or by interfering with the binding of the MPL CAR to the MPL antigen expressed on the cancer cells. In an exemplary embodiment, the accidental insertion of a MPL-CAR into MPL expressing cancer cells (e.g., leukemia cells) can be reduced by inclusion of a MPL binding agent (e.g., a MPL antibody or scFv) or an agent that interferes with the binding of the CAR to the MPL antigen (e.g., soluble MPL receptor, e.g., MPL-ECD-Fc or MPL-ECD or a fragment of MPL extracellular domain) before and/or during the step of infection with the CAR encoding virus. In one embodiment, an antigen binding agent against MPL is an antigen binding portion, e.g., CDRs, of vL and vH fragments targeting this antigen or of an antibody, e.g., an antibody described in US20120269814A1, U.S. Pat. No. 6,342,220 B1, EP1616881A1 or WO 02568109. In one embodiment, an antigen binding agent against MPL is an antibody, an antibody fragment or an antibody-like moiety described in, e.g., US20120269814A1, U.S. Pat. No. 6,342,220 B1, EP1616881A1 or WO 02568109. In another exemplary embodiment, the accidental insertion of a MPL-CAR into MPL expressing cancer cells (e.g., leukemia cells) can be reduced by co-expressing the membrane anchored form of MPL receptor or its epitope targeted by the MPL CAR, or Membrane anchored form of Protein L or membrane anchored form of an anti-idiotype antibody targeting the scFv region of the MPL CAR in the packaging cells and/or on the envelop of the viral vector encoding the CAR. In another exemplary embodiment, the accidental insertion of a MPL-CAR into MPL expressing cancer cells (e.g., leukemia cells) can be reduced by reducing or eliminating the expression of MPL CAR in the packaging cells and/or on the envelop of the viral vector encoding the MPL CAR.

In another exemplary embodiment, the accidental insertion of a CLL-1-CAR into CLL-1 expressing cancer cells (e.g., leukemia cells) can be reduced by reducing or eliminating the expression of CLL-1 CAR on the envelop of the viral vector encoding the CLL-1 CAR or by interfering with the binding of the CLL-1 CAR to the CLL-1 antigen expressed on the cancer cells. In an exemplary embodiment, the accidental insertion of a CLL-1-CAR into CLL-1 expressing cancer cells (e.g., leukemia cells) can be reduced by inclusion of a CLL-1 binding agent (e.g., a CLL-1 antibody or scFv) or an agent that interferes with the binding of the CAR to the CLL-1 antigen (e.g., soluble CLL-1 receptor, e.g., CLL-1-ECD-Fc or CLL-1-ECD or a fragment of CLL-1 extracellular domain) before and/or during the step of infection with the CAR encoding virus. In one embodiment, an antigen binding agent against CLL-1 is an antigen binding portion, e.g., CDRs, of vL and vH fragments targeting this antigen or of an antibody, e.g., an antibody described in WO 2013169625 or US 2010/0285037 A1. In one embodiment, an antigen binding agent against MPL is an antibody, an antibody fragment or an antibody-like moiety described in, e.g., WO 2013169625 or US 2010/0285037 A1. In another exemplary embodiment, the accidental insertion of a CLL-1-CAR into CLL-1 expressing cancer cells (e.g., leukemia cells) can be reduced by co-expressing the membrane anchored form of CLL-1 receptor or its epitope targeted by the CLL-1 CAR, or Membrane anchored form of Protein L or membrane anchored form of an anti-idiotype antibody targeting the scFv region of the CLL-1 CAR in the packaging cells and/or on the envelop of the viral vector encoding the CAR. In another exemplary embodiment, the accidental insertion of a CLL-1-CAR into CLL-1 expressing cancer cells (e.g., leukemia cells) can be reduced by reducing or eliminating the expression of CLL-1 CAR in the packaging cells and/or on the envelop of the viral vector encoding the CLL-1 CAR.

In another exemplary embodiment, the accidental insertion of a FLT3-CAR into FLT3 expressing cancer cells (e.g., leukemia cells) can be reduced by reducing or eliminating the expression of FLT3 CAR on the envelop of the viral vector encoding the FLT3 CAR or by interfering with the binding of the FLT3 CAR to the FLT3 antigen expressed on the cancer cells. In an exemplary embodiment, the accidental insertion of a FLT3-CAR into FLT3 expressing cancer cells (e.g., leukemia cells) can be reduced by inclusion of a FLT3 binding agent (e.g., a FLT3 antibody or scFv) or an agent that interferes with the binding of the CAR to the FLT3 antigen (e.g., soluble FLT3 receptor, e.g., FLT3-ECD-Fc or FLT3-ECD or a fragment of FLT3 extracellular domain) before and/or during the step of infection with the CAR encoding virus. In one embodiment, an antigen binding agent against FLT3 is an antigen binding portion, e.g., CDRs, of vL and vH fragments targeting this antigen or of an antibody, e.g., an antibody described in WO2011076922, U.S. Pat. No. 5,777,084, EP0754230, US20090297529, and several commercial catalog antibodies (R&D, ebiosciences, Abeam). In one embodiment, an antigen binding agent against MPL is an antibody, an antibody fragment or an antibody-like moiety described in, e.g., WO2011076922, U.S. Pat. No. 5,777,084, EP0754230, US20090297529, and several commercial catalog antibodies (R&D, ebiosciences, Abeam). In another exemplary embodiment, the accidental insertion of a FLT3-CAR into FLT3 expressing cancer cells (e.g., leukemia cells) can be reduced by co-expressing the membrane anchored form of FLT3 receptor or its epitope targeted by the FLT3 CAR, or Membrane anchored form of Protein L or membrane anchored form of an anti-idiotype antibody targeting the scFv region of the FLT3 CAR in the packaging cells and/or on the envelop of the viral vector encoding the CAR. In another exemplary embodiment, the accidental insertion of a FLT3-CAR into FLT3 expressing cancer cells (e.g., leukemia cells) can be reduced by reducing or eliminating the expression of FLT3 CAR in the packaging cells and/or on the envelop of the viral vector encoding the FLT3 CAR.

In another exemplary embodiment, the accidental insertion of a ROR1-CAR into ROR1 expressing cancer cells (e.g., leukemia or lymphoma cells) can be reduced by reducing or eliminating the expression of ROR1 CAR on the envelop of the viral vector encoding the ROR1 CAR or by interfering with the binding of the ROR1 CAR to the ROR1 antigen expressed on the cancer cells. In an exemplary embodiment, the accidental insertion of a ROR1-CAR into ROR1 expressing cancer cells (e.g., leukemia cells) can be reduced by inclusion of a ROR1 binding agent (e.g., a ROR1 antibody or scFv) or an agent that interferes with the binding of the CAR to the ROR1 antigen (e.g., soluble ROR1 receptor, e.g., ROR1-ECD-Fc or ROR1-ECD or a fragment of ROR1 extracellular domain) before and/or during the step of infection with the CAR encoding virus. In one embodiment, an antigen binding agent against ROR1 is an antigen binding portion, e.g., CDRs, of vL and vH fragments targeting this antigen or of an antibody, e.g., an antibody described in WO 2011159847; and US20130101607, and several commercial catalogs (R&D, ebiosciences, Abeam). In one embodiment, an antigen binding agent against ROR1 is an antibody, an antibody fragment or an antibody-like moiety described in, e.g., WO 2011159847; and US20130101607, and several commercial catalog (R&D, ebiosciences, Abeam). In another exemplary embodiment, the accidental insertion of a ROR1-CAR into ROR1 expressing cancer cells (e.g., leukemia cells) can be reduced by co-expressing the membrane anchored form of ROR1 receptor or its epitope targeted by the ROR1 CAR, or Membrane anchored form of Protein L or membrane anchored form of an anti-idiotype antibody targeting the scFv region of the ROR1 CAR in the packaging cells and/or on the envelop of the viral vector encoding the CAR. In another exemplary embodiment, the accidental insertion of a ROR1-CAR into ROR1 expressing cancer cells (e.g., leukemia cells) can be reduced by reducing or eliminating the expression of ROR1 CAR in the packaging cells and/or on the envelop of the viral vector encoding the ROR1 CAR.

In another exemplary embodiment, the accidental insertion of a LYM1-CAR into LYM1 expressing cancer cells (e.g., leukemia or lymphoma cells) can be reduced by reducing or eliminating the expression of LYM1 CAR on the envelop of the viral vector encoding the LYM1 CAR or by interfering with the binding of the LYM1 CAR to the LYM1 antigen expressed on the cancer cells. In an exemplary embodiment, the accidental insertion of a LYM1-CAR into LYM1 expressing cancer cells (e.g., leukemia cells) can be reduced by inclusion of a LYM1 binding agent (e.g., a LYM1 antibody or scFv) or an agent that interferes with the binding of the CAR to the LYM1 antigen (e.g., soluble LYM1 receptor, e.g., LYM1-ECD-Fc or LYM1-ECD or a fragment of LYM1 extracellular domain) before and/or during the step of infection with the CAR encoding virus. In one embodiment, an antigen binding agent against LYM1 is an antigen binding portion, e.g., CDRs, of vL and vH fragments targeting this antigen or of an antibody, e.g., an antibody described in US20160355590A1. In one embodiment, an antigen binding agent against LYM1 is an antibody, an antibody fragment or an antibody-like moiety described in, e.g., US20160355590A1. In another exemplary embodiment, the accidental insertion of a LYM1-CAR into LYM1 expressing cancer cells (e.g., leukemia or lymphoma cells) can be reduced by co-expressing the membrane anchored form of LYM1 receptor or its epitope targeted by the LYM1 CAR, or Membrane anchored form of Protein L or membrane anchored form of an anti-idiotype antibody targeting the scFv region of the LYM1 CAR in the packaging cells and/or on the envelop of the viral vector encoding the CAR. In another exemplary embodiment, the accidental insertion of a LYM1-CAR into LYM1 expressing cancer cells (e.g., leukemia cells) can be reduced by reducing or eliminating the expression of LYM1 CAR in the packaging cells and/or on the envelop of the viral vector encoding the LYM1 CAR.

In another exemplary embodiment, the accidental insertion of a LYM2-CAR into LYM2 expressing cancer cells (e.g., leukemia or lymphoma cells) can be reduced by reducing or eliminating the expression of LYM2 CAR on the envelop of the viral vector encoding the LYM2 CAR or by interfering with the binding of the LYM2 CAR to the LYM2 antigen expressed on the cancer cells. In an exemplary embodiment, the accidental insertion of a LYM2-CAR into LYM2 expressing cancer cells (e.g., leukemia or lymphoma cells) can be reduced by inclusion of a LYM2 binding agent (e.g., a LYM2 antibody or scFv) or an agent that interferes with the binding of the CAR to the LYM2 antigen (e.g., soluble LYM2 receptor, e.g., LYM2-ECD-Fc or LYM2-ECD or a fragment of LYM2 extracellular domain) before and/or during the step of infection with the CAR encoding virus. In another exemplary embodiment, the accidental insertion of a LYM2-CAR into LYM2 expressing cancer cells (e.g., leukemia cells) can be reduced by co-expressing the membrane anchored form of LYM2 receptor or its epitope targeted by the LYM2 CAR, or Membrane anchored form of Protein L or membrane anchored form of an anti-idiotype antibody targeting the scFv region of the LYM2 CAR in the packaging cells and/or on the envelop of the viral vector encoding the CAR. In another exemplary embodiment, the accidental insertion of a LYM2-CAR into LYM2 expressing cancer cells (e.g., leukemia cells) can be reduced by reducing or eliminating the expression of LYM2 CAR in the packaging cells and/or on the envelop of the viral vector encoding the LYM2 CAR.

In another exemplary embodiment, the accidental insertion of a BST1/CD157-CAR into BST1/CD157 expressing cancer cells (e.g., leukemia cells) can be reduced by reducing or eliminating the expression of BST1/CD157 CAR on the envelop of the viral vector encoding the BST1/CD157 CAR or by interfering with the binding of the BST1/CD157 CAR to the BST1/CD157 antigen expressed on the cancer cells. In an exemplary embodiment, the accidental insertion of a BST1/CD157-CAR into BST1/CD157 expressing cancer cells (e.g., leukemia cells) can be reduced by inclusion of a BST1/CD157 binding agent (e.g., a BST1/CD157 antibody) or an agent that interferes with the binding of the CAR to the BST1/CD157 antigen (e.g., soluble BST1/CD157 receptor, e.g., BST1/CD157-ECD-Fc or BST1/CD157-ECD or a fragment of BST1/CD157 extracellular domain) before and/or during the step of infection with the CAR encoding virus. In another exemplary embodiment, the accidental insertion of a BST1/CD157-CAR into BST1/CD157 expressing cancer cells (e.g., leukemia cells) can be reduced by co-expressing the membrane anchored form of BST1/CD157 receptor or its epitope targeted by the BST1/CD157 CAR, or Membrane anchored form of Protein L or membrane anchored form of an anti-idiotype antibody targeting the scFv region of the BST1/CD157 CAR in the packaging cells and/or on the envelop of the viral vector encoding the CAR. In another exemplary embodiment, the accidental insertion of a BST1/CD157-CAR into BST1/CD157 expressing cancer cells (e.g., leukemia cells) can be reduced by reducing or eliminating the expression of BST1/CD157 CAR in the packaging cells and/or on the envelop of the viral vector encoding the BST1/CD157 CAR.

In another exemplary embodiment, the accidental insertion of a CD179B-CAR into CD179B expressing cancer cells (e.g., leukemia cells) can be reduced by reducing or eliminating the expression of CD179B CAR on the envelop of the viral vector encoding the CD179B CAR or by interfering with the binding of the CD179B CAR to the CD179B antigen expressed on the cancer cells. In an exemplary embodiment, the accidental insertion of a CD179B-CAR into CD179B expressing cancer cells (e.g., leukemia cells) can be reduced by inclusion of a CD179B binding agent (e.g., a CD179B antibody or scFv) or an agent that interferes with the binding of the CAR to the CD179B antigen (e.g., soluble CD179B receptor, e.g., CD179B-ECD-Fc or CD179B-ECD or a fragment of CD179B extracellular domain) before and/or during the step of infection with the CAR encoding virus. In another exemplary embodiment, the accidental insertion of a CD179B-CAR into CD179B expressing cancer cells (e.g., leukemia cells) can be reduced by co-expressing the membrane anchored form of CD179B receptor or its epitope targeted by the CD179B CAR in the packaging cells and/or on the envelop of the viral vector encoding the CAR. In another exemplary embodiment, the accidental insertion of a CD179B-CAR into CD179B expressing cancer cells (e.g., leukemia cells) can be reduced by reducing or eliminating the expression of CD179B CAR in the packaging cells and/or on the envelop of the viral vector encoding the CD179B CAR.

In another exemplary embodiment, the accidental insertion of a CD70-CAR into CD70 expressing cancer cells (e.g., leukemia or lymphoma cells) can be reduced by reducing or eliminating the expression of CD70 CAR on the envelop of the viral vector encoding the CD70 CAR or by interfering with the binding of the CD70 CAR to the CD70 antigen expressed on the cancer cells. In an exemplary embodiment, the accidental insertion of a CD70-CAR into CD70 expressing cancer cells (e.g., leukemia cells) can be reduced by inclusion of a CD70 binding agent (e.g., a CD70 antibody or scFv) or an agent that interferes with the binding of the CAR to the CD70 antigen (e.g., soluble CD70 receptor, e.g., CD70-ECD-Fc or CD70-ECD or a fragment of CD70 extracellular domain) before and/or during the step of infection with the CAR encoding virus. In another exemplary embodiment, the accidental insertion of a CD70-CAR into CD70 expressing cancer cells (e.g., leukemia cells) can be reduced by co-expressing the membrane anchored form of CD70 receptor or its epitope targeted by the CD70 CAR in the packaging cells and/or on the envelop of the viral vector encoding the CAR. In another exemplary embodiment, the accidental insertion of a CD70-CAR into CD70 expressing cancer cells (e.g., leukemia cells) can be reduced by reducing or eliminating the expression of CD70 CAR in the packaging cells and/or on the envelop of the viral vector encoding the CD70 CAR.

In another exemplary embodiment, the accidental insertion of a CD23-CAR into CD23 expressing cancer cells (e.g., leukemia or lymphoma cells) can be reduced by reducing or eliminating the expression of CD23 CAR on the envelop of the viral vector encoding the CD23 CAR or by interfering with the binding of the CD23 CAR to the CD23 antigen expressed on the cancer cells. In an exemplary embodiment, the accidental insertion of a CD23-CAR into CD23 expressing cancer cells (e.g., leukemia cells) can be reduced by inclusion of a CD23 binding agent (e.g., a CD23 antibody or scFv) or an agent that interferes with the binding of the CAR to the CD23 antigen (e.g., soluble CD23 receptor, e.g., CD23-ECD-Fc or CD23-ECD or a fragment of CD23 extracellular domain) before and/or during the step of infection with the CAR encoding virus. In another exemplary embodiment, the accidental insertion of a CD23-CAR into CD23 expressing cancer cells (e.g., leukemia cells) can be reduced by co-expressing the membrane anchored form of CD23 receptor or its epitope targeted by the CD23 CAR in the packaging cells and/or on the envelop of the viral vector encoding the CAR. In another exemplary embodiment, the accidental insertion of a CD23-CAR into CD23 expressing cancer cells (e.g., leukemia cells) can be reduced by reducing or eliminating the expression of CD23 CAR in the packaging cells and/or on the envelop of the viral vector encoding the CD23 CAR.

In another exemplary embodiment, the accidental insertion of a MESOTHELIN-CAR into MESOTHELIN expressing cancer cells (e.g., ovarian cancer) can be reduced by reducing or eliminating the expression of MESOTHELIN CAR on the envelop of the viral vector encoding the MESOTHELIN CAR or by interfering with the binding of the MESOTHELIN CAR to the MESOTHELIN antigen expressed on the cancer cells. In an exemplary embodiment, the accidental insertion of a MESOTHELIN-CAR into MESOTHELIN expressing cancer cells (e.g., ovarian cancer) can be reduced by inclusion of a MESOTHELIN binding agent (e.g., a MESOTHELIN antibody or scFv) or an agent that interferes with the binding of the CAR to the MESOTHELIN antigen (e.g., soluble MESOTHELIN receptor, e.g., MESOTHELIN-ECD-Fc or MESOTHELIN-ECD or a fragment of MESOTHELIN extracellular domain) before and/or during the step of infection with the CAR encoding virus. In one embodiment, an antigen binding agent against MSLN is an antigen binding portion, e.g., CDRs, of vL and vH fragments targeting this antigen or of an antibody, e.g., an antibody described in WO2017021356 and WO2012087962. In one embodiment, an antigen binding agent against MSLN is an antibody, an antibody fragment or an antibody-like moiety described in, e.g., WO2017021356 and WO2012087962. In another exemplary embodiment, the accidental insertion of a MESOTHELIN-CAR into MESOTHELIN expressing cancer cells (e.g., leukemia cells) can be reduced by co-expressing the membrane anchored form of MESOTHELIN receptor or its epitope targeted by the MESOTHELIN CAR in the packaging cells and/or on the envelop of the viral vector encoding the CAR. In another exemplary embodiment, the accidental insertion of a MESOTHELIN-CAR into MESOTHELIN expressing cancer cells (e.g., leukemia cells) can be reduced by reducing or eliminating the expression of MESOTHELIN CAR in the packaging cells and/or on the envelop of the viral vector encoding the MESOTHELIN CAR.

In another exemplary embodiment, the accidental insertion of a HER2-CAR into HER2 expressing cancer cells (e.g., breast cancer cells) can be reduced by reducing or eliminating the expression of HER2 CAR on the envelop of the viral vector encoding the HER2 CAR or by interfering with the binding of the HER2 CAR to the HER2 antigen expressed on the cancer cells. In an exemplary embodiment, the accidental insertion of a HER2-CAR into HER2 expressing cancer cells (e.g., breast cancer cells) can be reduced by inclusion of a HER2 binding agent (e.g., a HER2 antibody or scFv) or an agent that interferes with the binding of the CAR to the HER2 antigen (e.g., soluble HER2 receptor, e.g., HER2-ECD-Fc or HER2-ECD or a fragment of HER2 extracellular domain) before and/or during the step of infection with the CAR encoding virus. In one embodiment, an antigen binding agent against Her2 is an antigen binding portion, e.g., CDRs, of vL and vH fragments targeting this antigen or of an antibody, e.g., an antibody described in US20110059090, U.S. Pat. No. 8,652,474 or 5,821,337. In one embodiment, an antigen binding agent against Her2 is an antibody, an antibody fragment or an antibody-like moiety described in, e.g., US20110059090, U.S. Pat. No. 8,652,474 or 5,821,337. In another exemplary embodiment, the accidental insertion of a HER2-CAR into HER2 expressing cancer cells (e.g., leukemia cells) can be reduced by co-expressing the membrane anchored form of HER2 receptor or its epitope targeted by the HER2 CAR in the packaging cells and/or on the envelop of the viral vector encoding the CAR. In another exemplary embodiment, the accidental insertion of a HER2-CAR into HER2 expressing cancer cells (e.g., leukemia cells) can be reduced by reducing or eliminating the expression of HER2 CAR in the packaging cells and/or on the envelop of the viral vector encoding the HER2 CAR.

A number of strategies have been in use to downregulate or eliminate the expression of a protein expressed on the surface of cells for the purpose of cellular therapies, including siRNA/ShRNA mediated gene knock-down and gene editing systems (e.g. CAS9/CRISP, Zn finger nucleases and TALONS) to knock out or mutate one or both alleles of a specific gene. These approaches, however, suffer from a number of limitations including off target mutational effects, incomplete knock-down, irreversibility and use of specialized and complex delivery systems. Thus, there is a need for a general system to block the function of a cell surface expressed protein without altering its gene or mRNA. The current disclosure discloses a general method to block the function of any cell surface expressed endogenous protein by expressing in cis in the cell an antigen masking receptor (AMR) capable of binding to the endogenous protein and/or interfering with one or more functions of the said protein. In some embodiments, an antigen masking receptor comprises an antigen binding domain that binds to the endogenous protein and a localization domain. In some embodiments, an antigen masking receptor comprises an antigen binding domain that binds to the endogenous protein, an optional hinge domain and an optional membrane anchoring domain. The antigen binding domain of AMR may comprise of (1) an antibody; (2) an antibody fragment (e.g. a Fv, a Fab, a (Fab')2); (3) a heavy chain variable region of an antibody (vH domain) or a fragment thereof, (4) a light chain variable region of an antibody (vL domain) or a fragment thereof, (5) a single chain variable fragment (scFv) or a fragment thereof, (6) a single domain antibody (SDAB) or a fragment thereof, (7) a camelid VHH domain or a fragment thereof, (8) a monomeric variable region of an antibody; (9) a non-immunoglobulin antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) a receptor; and/or (11) a ligand.

The hinge domain or spacer region of an AMR connects its antigen binding domain to the membrane anchoring domain. The hinge regions include, but are not limited to, Fc fragments of antibodies or fragments or derivatives thereof, hinge regions of antibodies or fragments or derivatives thereof, CH2 regions of antibodies, CH3 regions of antibodies, artificial spacer sequences or combinations thereof. Examples of hinge regions include but are not limited to CD8a hinge, and artificial spacers made of polypeptides which may be as small as, for example, Gly3 or CH1 and CH3 domains of IgGs (such as human IgG4). In some embodiments, the hinge region is any one or more of (i) a hinge, CH2 and CH3 regions of IgG4, (ii) a hinge region of IgG4, (iii) a hinge and CH2 of IgG4, (iv) a hinge region of CD8a, (v) a hinge, CH2 and CH3 regions of IgG1, (vi) a hinge region of IgG1, (vi) a hinge and CH2 region of IgG1 or a (vii) a hinge region of CD28. The nucleic acid and amino acid SEQ ID NOs of several hinge/spacer regions are provided in Table 6. Other hinge regions will be apparent to those of skill in the art and may be used in connection with alternate embodiments of the disclosure.

The membrane anchoring domain of an AMR anchors the AMR to the cytoplasmic membrane. In an embodiment, the AMR is anchored to the membrane via a lipid anchor, i.e., it is a lipid anchored protein, e.g., a glycosylphosphatidylinositol-linked protein (GPI). In some embodiments, the extracellular element is associated with the host cell membrane through a tether. In this embodiment, the extracellular element includes a GPI signal sequence on its C-terminal end. In some embodiments, the human GPI signal sequence is, for example CD24 GPI signal sequence, a CNTN1 GPI signal sequence or a EFNA1 GPI signal sequence etc. The amino acid sequences of several GPI linkers are provided in SEQ ID NOs 11800-11809. The nucleic acid and amino acid sequences of exemplary AMR with CD24 GPI linker are provided in SEQ ID NOs: 1955-2203 and SEQ ID NOs (PRT): 7841-8089, respectively. The target antigens of these AMR can be determined by looking at Table 7 as they contain the same scFv fragments as shown in Table 7 and the order of their target antigens is the same as the order of the target antigens of the scFvs shown in Table 7.

In another embodiment, the membrane anchoring domain of an AMR is a transmembrane domain (TMD).

The nucleic acid and amino acid sequences of exemplary AMR with CD28 hinge and transmembrane domain are provided in SEQ ID NOs (DNA): 2705-2953 and SEQ ID NOs (PRT): 8591-8839, respectively (Table 8). The target antigens of these AMR can be determined by looking at Table 7 as they contain the same scFv fragments as shown in Table 7 and the order of their target antigens is the same as the order of the target antigens of the scFvs shown in Table 7.

The nucleic acid and amino acid sequences of exemplary AMR with CD8 hinge and transmembrane domain are provided in SEQ ID NOs (DNA): 1705-1953 and SEQ ID NOs (PRT): 7591-7839, respectively (Table 8). The target antigens of these AMR can be determined by looking at Table 7 as they contain the same scFv fragments as shown in Table 7 and the order of their target antigens is the same as the order of the target antigens of the scFvs shown in Table 7.

In an embodiment, the AMR carries a transmembrane domain and a cytosolic costimulatory domain.

The nucleic acid and amino acid sequences of exemplary AMR/CARs with CD8 hinge and transmembrane domain and a 41BB costimulatory domain and a CD3z activation domain are provided in SEQ ID NOs (DNA): 1455-1703 and SEQ ID NOs (PRT): 7341-7589, respectively (Table 8). The target antigens of these AMR can be determined by looking at Table 7 as they contain the same scFv fragments as shown in Table 7 and the order of their target antigens is the same as the order of the target antigens of the scFvs shown in Table 7.

The disclosure also provides a method to regulate the expression of the AMR by joining it to a protein destabilization or a protein stabilization motif. Table 8 provides the nucleic acid and amino acid SEQ ID NOs of several exemplary AMRs with the protein destabilization motif dTAG. The expression and activity of these AMRs can be controlled in a reversible manner by administration of drugs such as dTAG-13. Table 8 also provides the nucleic acid and amino acid SEQ ID NOs of several exemplary AMRs with the protein stabilization motif ShildTAG. The expression and activity of these AMRs is stabilized upon administration of a directed ligand, Shield-1. The target antigens of the above AMRs can be determined by looking at Table 7 as they contain the same scFv fragments as shown in Table 7 and the order of their target antigens is the same as the order of the target antigens of the scFvs shown in Table 7.

In an embodiment, an AMR carries a domain that anchors it to a cellular compartment (e.g., endoplasmic reticulum). For example, the KDEL motif when present at the C-terminus of a protein prevents it from being secreted from the endoplasmic reticulum (ER) and facilitates its return if it is accidentally exported. The AMR with a KDEL may also carry a protein destabilization or a protein stabilization motif. Table 8 provides the nucleic acid and amino acid SEQ ID NOs of several exemplary scFv carrying the KDEL motif that anchors them to the ER and several scFv that carry a protein destabilization motif (dTAG) or a protein stabilization motif (ShildTAG) and a C-terminal KDEL motif. The target antigens of the above AMRs can be determined by looking at Table 7 as they contain the same scFv fragments as shown in Table 7 and the order of their target antigens is the same as the order of the target antigens of the scFvs shown in Table 7.

The AMR of the disclosure can be expressed in cells stably or transiently. They can be expressed in cells using techniques known in the art, such as use of viral vectors. Viral vectors which may be used to express AMR include but are not limited SIN lentiviral vectors, retroviral vectors, foamy virus vectors, adeno-associated virus (AAV) vectors, hybrid vectors and/or plasmid transposons (for example sleeping beauty transposon system) or integrase based vector systems. Other vectors that may be used in connection with alternate embodiments of the disclosure will be apparent to those of skill in the art. The AMR can be expressed by themselves or they can be expressed with nucleic acids encoding other molecules, such as CAR, SIR, Ab-TCR, TFP, recombinant TCRs, other signaling proteins or therapeutic controls.

The disclosure also provides nucleic acids, polypeptides and vectors encoding the AMR of the disclosure. The disclosure also provides cells (e.g., T cells, hematopoietic stem cells, CD34+ stem cells, iPSC etc.) expressing the AMR of the disclosure. The cells expressing the AMR of the disclosure may also express other receptors, such as CAR, SIR, Ab-TCR, TFP, recombinant TCR etc. The cells expressing the AMR of the disclosure may also have other genetic modifications, such as knock-down or knock-out of different genes.

The disclosure also provides methods of treating and preventing a disease in a subject by administration of cells encoding the AMR of the disclosure. The method may further involve administration of other cells along with AMR cells. For example, a subject receiving AMR-expressing CD34+ cells may also receive CAR-T cells. The AMR-expressing cells may be autologous or allogeneic in origin. In some embodiment, the method involves administration of a cell expressing an AMR that is fused with a protein destabilization or protein stabilization domain followed by administration to the subject of a ligand (e.g., a chemical ligand; e.g., dTAG-13 or Shield-1) that results in degradation or stabilization of the AMR fusion protein.

The methods and composition of the disclosure can be also used to modify the hematopoietic stem cells and progenitor cells with AMR to protect them against killing induced by immune effector cells e.g., CAR-T, TCR-T, NK cells, TILs as well as other forms of immunotherapies (e.g., antibodies, bispecific antibodies, DARTs, antibody drug conjugates etc.) targeting antigens expressed on non-myeloid cells (e.g., B lymphocytes and plasma cells).

The disclosure can be also used to modify the hematopoietic stem cells and progenitor cells with AMR directed against the entry receptors for different pathogens (e.g., viruses) to protect them against infection caused by the pathogens (e.g., HIV-1, HTLV-1 etc.).

The disclosure includes a method of protecting a hematopoietic stem or progenitor cell from a chimeric antigen receptor (CAR) T cell therapy (including next generation CAR-T therapy) and/or antibody therapy in a subject in need thereof. The method comprises administering to the subject a modified hematopoietic stem or progenitor cell, wherein the stem or progenitor cell comprises a nucleic acid capable of encoding an antigen masking receptor (AMR) that binds to an endogenous protein or a portion thereof, wherein the endogenous protein comprises an antigen domain targeted by a CAR or an antibody (e.g., a bispecific antibody or an antibody drug conjugate). In one embodiment, the AMR comprises an antigen binding domain that binds to the same epitope as targeted by the CAR or an antibody. In another embodiment, the AMR comprises an antigen binding domain that binds to an epitope that overlaps with the epitope targeted by the CAR or an antibody. In another embodiment, the AMR competes with CAR for binding to the endogenous polypeptide targeted by the CAR. In another embodiment, the AMR competes with an antibody for binding to the endogenous polypeptide targeted by the antibody. In one embodiment, the AMR further comprises a hinge domain. In one embodiment, the AMR further comprises a transmembrane domain and an optional cytosolic domain. In an embodiment, the AMR comprises an antigen binding domain, a hinge domain and a transmembrane domain. In one embodiment, the AMR is expressed on the cell surface as a transmembrane protein. In an embodiment, the AMR comprises an antigen binding domain, a hinge domain, a transmembrane domain, an optional costimulatory domain (e.g., 41BB domain or CD28 costimulatory domain) and an optional activation domain (e.g., CD3z domain). In an embodiment, the AMR further carries a protein stabilization or a protein destabilization domain (e.g., FKBP12-F36V, FRB or Shieldtag domain) that can be used to regulate its expression at the post-translational level following the administration of a suitable ligand (e.g., dTAG-13 or Shield1 or rapamycin etc). In one embodiment, the AMR is expressed on the cell surface as a membrane anchored protein (e.g., a lipid anchored protein, e.g., a glycosylphosphatidylinositol-linked proteins (GPI). In another embodiment, the AMR is expressed as a secreted protein. In some embodiments, the AMR is expressed on the cells constitutively. In other embodiments, the AMR is expressed on the cells in a conditional manner, e.g., inducible manner. Methods to express a gene/protein in an inducible manner are known in the art, and include Tet-inducible system, dTAG system and the like. In one embodiment, the method of the disclosure further comprises administering the CAR T cell therapy or an antibody therapy to the subject in need thereof. In another embodiment, the modified cell further comprises an AMR capable of binding to an endogenous polypeptide targeted by the CAR thereby competing with and preventing the binding of the CAR to the endogenous polypeptide.

The disclosure also includes a method for generating a modified hematopoietic stem or progenitor cell. The method comprises introducing a nucleic acid capable of encoding an AMR that binds to an endogenous gene or a portion thereof into the cell, wherein the endogenous gene encodes a polypeptide comprising an antigen domain targeted by a chimeric antigen receptor (CAR). In one embodiment, the method comprises obtaining the cell from a subject in need of CART cell therapy.

In one embodiment, the endogenous gene/protein encodes a tumor antigen. In another embodiment, the endogenous gene is expressed on a tumor cell targeted by the CAR or the antibody. In exemplary embodiment, the endogenous gene encodes CD33, CD123, MPL, CD19, CD22, CD20, BCMA, CS1, FLT3, CSF2RA, IL6R, LAMP1, TSLRP, CD4, CXCR4, GPC3, CD45, CD44v, CD43, CD32, CD38, CD79b, CD138, CD179b, CD70, Folate Receptor beta, WT1, NY-ESO1, CLL1, IL1Ra, CLEC5A, PR1, TGFbeta, ROR1, TnAg, CD200R, Kappa Light Chain, TCRβ1 constant chain, TCRβ2 constant chain, TCRα constant chain, TCRγ, TCRδ, CD5, CD7, CD3ε, IL1RAP, Lym1, Lym2 or BST1/CD157.

The target antigens and the SEQ ID NOs of the various scFv targeting those antigens that can be used in the construction of AMR of the disclosure are shown in Table 7. In an exemplary embodiment, the CAR and the AMR that is used to protect the normal cells (e.g., hematopoietic stem cell or progenitor cells) from the CAR share the same scFv amino acid sequence. In one embodiment, the CAR and the AMR that is used to protect the normal cells (e.g., hematopoietic stem cell or progenitor cells) from the CAR share the scFv amino acid sequence that has more than 80%, 90% or 95% sequence homology. In an exemplary embodiment, the CAR and the AMR that is used to protect the normal cells (e.g., hematopoietic stem cell or progenitor cells) from the CAR share the same amino acid sequence in their antigen binding domains, i.e., CDR regions of their vL and vH fragments. In one embodiment, the CAR and the AMR that is used to protect the normal cells (e.g., hematopoietic stem cell or progenitor cells) from the CAR share one or more CDR regions of their vL and vH fragments. In one embodiment, the CAR and the AMR that is used to protect the normal cells (e.g., hematopoietic stem cell or progenitor cells) from the CAR have one or more CDR regions of their vL and vH fragments that have more than 80%, 90% or 95% sequence homology. In one embodiment, the CAR and the AMR that is used to protect the normal cells (e.g., hematopoietic stem cell or progenitor cells) from the CAR bind to the same epitope on the target antigen. In one embodiment, the CAR and the AMR that is used to protect the normal cells (e.g., hematopoietic stem cell or progenitor cells) from the CAR bind to overlapping epitope on the target antigen. Exemplary CARs platforms whose toxicity on the normal hematopoietic stem cells and progenitor cells can be protected by AMR of the disclosure include but are not limited to first generation CARs, second generation CARs (e.g., CARs containing 41BB or CD28 co-stimulatory domains), 3rd generation CARs, SIRs, CTCRs, Ab-TCR, TFPs and the like.

In an exemplary embodiment, the antibody and the AMR that is used to protect the normal cells (e.g., hematopoietic stem cell or progenitor cells) from the antibody share the same amino acid sequence in their antigen binding domain, i.e., the CDRs of their vL and vH fragments. In one embodiment, the antibody and the AMR that is used to protect the normal cells (e.g., hematopoietic stem cell or progenitor cells) from the CAR share the scFv amino acid sequence that has more than 80%, 90% or 95% sequence homology. In one embodiment, the antibody and the AMR that is used to protect the normal cells (e.g., hematopoietic stem cell or progenitor cells) from the CAR have one or more CDR regions of their vL and vH fragments that have more than 80%, 90% or 95% sequence homology. In one embodiment, the CAR and the AMR that is used to protect the normal cells (e.g., hematopoietic stem cell or progenitor cells) from the CAR bind to the same epitope on the target antigen. In one embodiment, the CAR and the AMR that is used to protect the normal cells (e.g., hematopoietic stem cell or progenitor cells) from the CAR bind to overlapping epitope on the target antigen. Exemplary CARs platforms whose toxicity on the normal hematopoietic stem cells and progenitor cells can be protected by AMR of the disclosure include but are not limited to first generation CARs, second generation CARs (e.g., CARs containing 41BB or CD28 co-stimulatory domains), $3^{rd}$ generation CARs, SIRs, CTCRs, Ab-TCR, TFPs and the like.

Table 7 lists the target antigens and nucleic acid and amino acid SEQ ID NOs of various scFv fragments that can be used in the construction of CARs (including next generation CARs, such as SIR, Ab-TCR and TFP etc.), antibodies (including bispecific T cell engagers and DARTs) and antibody drug conjugates. Table 8 lists the nucleic acid and amino acid SEQ ID NOs of various construct encoding scFv, scFv-His, CARs and different AMRs (e.g., scFv-KDEL, scFv-dTAG-KDEL, scFv-ShieldTAG-KDEL, AMR with CD8 and CD28 hinge and transmembrane domains etc.). The target antigens of the various constructs listed in Table 8 are in the same order as the target antigens of scFv fragments shown in Table 7 and therefore the SEQ ID NO of an scFv-His, CAR and AMR targeting a specific target antigen and comprising a specific scFv can be determined from Tables 7 and 8.

In an exemplary embodiment, a CAR is a second generation MPL CAR (SEQ ID NO: 7482) containing a 41BB costimulatory domain and an antigen binding domain comprising scFv MPL-161 represented by SEQ ID NO: 6232 and an exemplary AMR that can be used to protect the hematopoietic stem cells and progenitor cells from the toxicity of immune cells (e.g., T cells or NK cells) expressing this CAR is represented by SEQ ID NO: 6482, 6483, 7732, 7733, 7982, 7983, 8232, 8233, 8482, 8483, 8732, 8733, 8982, 8983, 9232 or 9233.

In an exemplary embodiment, a CAR is a MPL TAC, or MPL TFP (SEQ ID NO: 12191) comprising an antigen binding domain comprising scFv MPL-161 represented by SEQ ID NO: 6232 and an exemplary AMR that can be used to protect the hematopoietic stem cells and progenitor cells from the toxicity of immune cells (e.g., T cells or NK cells) expressing this TFP is represented by SEQ ID NO: 6482, 6483, 7732, 7733, 7982, 7983, 8232, 8233, 8482, 8483, 8732, 8733, 8982, 8983, 9232 or 9233.

In an exemplary embodiment, a CAR is a MPL SIR with an antigen binding domain comprising vL and vH domains based on scFv MPL-161 represented by SEQ ID NO: 6232 and an exemplary AMR that can be used to protect the hematopoietic stem cells and progenitor cells from the toxicity of immune cells (e.g., T cells or NK cells) expressing this TFP is represented by SEQ ID NO: 6482, 6483, 7732, 7733, 7982, 7983, 8232, 8233, 8482, 8483, 8732, 8733, 8982, 8983, 9232 or 9233.

In an exemplary embodiment, a CAR is a second generation CD123 CAR (SEQ ID NO: 7399) containing a 41BB costimulatory domain and an antigen binding domain comprising scFv CD123-1172 represented by SEQ ID NO: 6149 and an exemplary AMR that can be used to protect the hematopoietic stem cells and progenitor cells from the toxicity of immune cells (e.g., T cells or NK cells) expressing this CAR is represented by SEQ ID NO: 6399, 7649, 7899, 8149, 8399, 8649, 8899, or 9149.

In an exemplary embodiment, a CAR is a CD123 TFP (SEQ ID NO: 12190) containing an antigen binding domain comprising scFv CD123-1172 represented by SEQ ID NO: 6149 and an exemplary AMR that can be used to protect the hematopoietic stem cells and progenitor cells from the toxicity of immune cells (e.g., T cells or NK cells) expressing this TFP is represented by SEQ ID NO: 6399, 7649, 7899, 8149, 8399, 8649, 8899, or 9149.

In an exemplary embodiment, a CAR is a CD123 SIR containing an antigen binding domain comprising vL and vH domains based on scFv CD123-1172 represented by SEQ ID NO: 6149 and an exemplary AMR that can be used to protect the hematopoietic stem cells and progenitor cells from the toxicity of immune cells (e.g., T cells or NK cells) expressing this TFP is represented by SEQ ID NO: 6399, 7649, 7899, 8149, 8399, 8649, 8899, or 9149.

In an exemplary embodiment, a CAR is a CD33 SIR, CD33 TAC, CD33 TFP (SEQ ID NO:12189) or a second generation CD33 CAR (SEQ ID NO:7385) comprising an antigen binding domain comprising and/or derived from scFv CD33-huMyc9 scFV represented by SEQ ID NO: 6135 and an exemplary AMR that can be used to protect the hematopoietic stem cells and progenitor cells from the toxicity of immune cells (e.g., T cells or NK cells) expressing this TFP/CAR is represented by SEQ ID NO: 6385, 6885, 7135, 7385, 7635, 7885, 8135, 8385, 8635, 8885 or 9135.

In an exemplary embodiment, a CAR is a FLT3 SIR, FLT3-TAC, or second generation FLT3 CAR (e.g., SEQ ID NO: 7552) containing an antigen binding domain comprising and/or derived from scFv FLT3-8B5 represented by SEQ ID NO: 6302 and an exemplary AMR that can be used to protect the hematopoietic stem cells and progenitor cells from the toxicity of immune cells (e.g., T cells or NK cells) expressing this CAR is represented by SEQ ID NO: 7052, 7302, 7802, 8052, 8302, 8552, 8802, or 9052.

In an exemplary embodiment, a CAR is a FLT3 TFP (e.g., SEQ ID NO: 12194) and exemplary AMR that can be used to protect the hematopoietic stem cells and progenitor cells from the toxicity of immune cells (e.g., T cells or NK cells) expressing this TFP is represented by SEQ ID NO: 1060, 1310, 1810, 2060, 2310, 2560 and 2810.

An exemplary AMR that binds to CD52 and can be used to protect immune cells (e.g., T cells, e.g., CAR-T cells) and stem cells from cytotoxicity of a CD52 antibody (e.g., CAMAPATH) has an antigen binding domain, i.e., scFv, with nucleic sequence represented by SEQ ID NO: 444 and amino acid sequence represented by SEQ ID NO: 6330. An exemplary AMRs that binds to CD52 is represented by SEQ ID NOs: 694, 944, 1194, 1444, 1694, 1944, 2194, 2444 and 2694.

The nucleic acid and amino acid SEQ ID NOs of additional exemplary CARs and the AMR that can be used to protect the normal healthy cells (e.g., hematopoietic stem cells and progenitor cells) against the cytotoxicity of such CAR expressing immune cells are presented in Table 8. The target antigen of the AMRs whose SEQ ID NOs are listed in Table 8 can be determined by reference to Table 7.

In some embodiments, more than one AMR can be used to protect against the cytotoxicity of a CAR expressing immune cell.

In one embodiment, the endogenous gene targeted by an AMR encodes a protein that acts as an entry receptor for a virus. Exemplary endogenous proteins that can be targeted by AMR to protect against infection by HIV-1 include CCR5, CXCR4 and CD4.

An exemplary AMR that can be used to protect the immune cells (e.g., T cells) and hematopoietic stem cells and progenitor cells from infection by HIV-1 binds to CCR5 and has an antigen binding domain, i.e., scFv, with nucleic sequence represented by SEQ ID NO: 447 and amino acid sequence represented by SEQ ID NO: 6337. An exemplary AMRs that binds to CCR5 is represented by SEQ ID NOs: 697, 947, 1197, 1447, 1697, 1947, 2197, 2447 or 2697.

An exemplary AMR that can be used to protect the immune cells (e.g., T cells) and the hematopoietic stem cells and progenitor cells from infection by HIV-1 binds to CXCR4 and has an antigen binding domain, i.e., scFv, with nucleic sequence represented by SEQ ID NO: 448 and amino acid sequence represented by SEQ ID NO: 6338. An exemplary AMRs that binds to CXCR4 is represented by SEQ ID NOs: 698, 948, 1198, 1448, 1698, 1948, 2198, 2448 or 2698.

An exemplary AMR that can be used to protect the immune cells (e.g., T cells) and the hematopoietic stem cells and progenitor cells from infection by HIV-1 binds to CD4 and has an antigen binding domain, i.e., scFv, with nucleic sequence represented by SEQ ID NO: 449 and amino acid sequence represented by SEQ ID NO: 6339. An exemplary AMRs that binds to CXCR4 is represented by SEQ ID NOs: 699, 949, 1199, 1449, 1699, 1949, 2199, 2449 or 2699.

In one embodiment, the endogenous gene targeted by an AMR encodes a protein that is target of an autoantibody or auto-reactive immune cell (e.g., T cell or NK cell).

In one embodiment, the cell is obtained from a source selected from the group consisting of peripheral blood mononuclear cells, mobilized peripheral blood stem cells, cord blood cells, bone marrow, lymph node, and spleen. In some embodiment, the cell is an induced pluripotent stem cell.

In one embodiment, the cell is $CD34^{+}$. In some embodiment, the cell is autologous while in other embodiments, the cell is allogeneic. In one embodiment, the method of the disclosure as described herein comprises expanding the cell. In another embodiment, the expanding is conducted prior to the step of introducing the nucleic acid encoding the AMR. In another embodiment, the expanding is conducted after the step of introducing the nucleic acid encoding the AMR. In another embodiment, the method of the disclosure as described herein comprises cryopreserving the cell. In yet another embodiment, the method further comprises thawing the cryopreserved cell prior to introducing the nucleic acid. In one embodiment, introducing the nucleic acid is conducted by a process selected from the group consisting of transducing the cell, transfecting the cell, and electroporating the cell. In another embodiment, the modified cell differentiates into at least one blood cell type in the subject. In yet another embodiment, the modified cell is capable of self-renewal after administration into the subject.

The disclosure provides a composition comprising the modified cell generated according to the method described above herein.

The disclosure also provides a pharmaceutical composition comprising the modified cell generated according to the method described above herein and a pharmaceutically acceptable carrier.

The disclosure provides a method for adoptive cell transfer therapy. The method comprises administering to a subject in need thereof an effective amount of a pharmaceutical composition comprising the modified cell generated according to the method described herein, wherein the subject is administered an effective amount of the cell described herein and a immune receptor cell therapy or antibody therapy (including bispecific antibodies, antibody drug conjugate etc.) that targets the antigen domain of the polypeptide encoded by the endogenous gene thereby treating the subject.

The disclosure provides a method comprising administering to the subject a therapeutically effective amount of a pharmaceutical composition comprising the modified cell generated according to the method described herein and administering an immune receptor cell therapy (e.g., CAR T cell therapy), wherein the immune receptor comprises an antigen binding domain that specifically targets the antigen domain of the polypeptide encoded by the endogenous gene, thereby treating the condition.

The disclosure provides a method comprising administering to the subject a therapeutically effective amount of a pharmaceutical composition comprising the modified cell generated according to the method described herein and administering an immune receptor cell therapy wherein the immune receptor can be a first generation CAR, a 2nd generation CAR (e.g., containing a single co-stimulatory domain), a third generation CAR (e.g., containing two or more costimulatory domains), a SIR, a cTCR, a TFP, an Ab-TCR, Tri-TAC, K13-CAR, a TCR or any of the next generation CARs.

The disclosure also provides a method comprising administering to the subject a therapeutically effective amount of a pharmaceutical composition comprising the modified cell generated according to the method described herein and administering an antibody therapy, wherein the antibody comprises an antigen binding domain that specifically targets the antigen domain of the polypeptide encoded by the endogenous gene, thereby treating the condition.

In one embodiment, the condition is an autoimmune disease. In another embodiment, the autoimmune disease is selected from the group consisting of Acquired Immunodeficiency Syndrome (AIDS), alopecia areata, ankylosing spondylitis, antiphospholipid syndrome, autoimmune Addison's disease, autoimmune hemolytic anemia, autoimmune hepatitis, autoimmune inner ear disease (AIED), autoimmune lymphoproliferative syndrome (ALPS), autoimmune thrombocytopenic purpura (ATP), Behcet's disease, cardiomyopathy, celiac sprue-dermatitis hepetiformis; chronic fatigue immune dysfunction syndrome (CFIDS), chronic inflammatory demyelinating polyneuropathy (CIPD), cicatricial pemphigoid, cold agglutinin disease, crest syndrome, Crohn's disease, Degos' disease, dermatomyositis juvenile, discoid lupus, essential mixed cryoglobulinemia, fibromyalgia-fibromyositis. Graves' disease, Guiiiain-Barre syndrome, Hashimoto's thyroiditis, idiopathic pulmonary fibrosis, idiopathic thrombocytopenia u ura (F P), IgA nephropathy, insulin-dependent diabetes mellitus, juvenile chronic arthritis (Still's disease), juvenile rheumatoid arthritis, Meniere's disease, mixed connective tissue disease, multiple sclerosis, myasthenia gravis, pernacious anemia, polyarteritis *nodosa*, polychondritis, polyglandular syndromes, polymyalgia rheumatica, polymyositis and dermatomvositis, primary agammaglobulinemia, primary biliary cirrhosis, psoriasis, psoriatic arthritis, Raynaud's phenomena, Reiter's syndrome, rheumatic fever, rheumatoid arthritis, sarcoidosis, scleroderma (progressive systemic sclerosis (PSS), also known as systemic sclerosis (SS)), Sjogren's syndrome, stiff-man syndrome, systemic lupus erythematosus, Takayasu arteritis, temporal arteritis/giant cell arteritis, ulcerative colitis, uveitis, vitiligo, Wegener's granulomatosis, and any combination thereof.

In another embodiment, the condition is a cancer. In yet another embodiment, the cancer is selected from the group consisting of but not limited to breast cancer, prostate cancer, ovarian cancer, cervical cancer, skin cancer, pancreatic cancer, colorectal cancer, renal cancer, liver cancer, brain cancer, lymphoma, leukemia, myeloma, Myelodysplastic syndrome, lung cancer, and any combination thereof.

Although early TCR and CAR T cell clinical data obtained in treating cancers has shown promising results, the risk to the patient is high, and some patients' T cells are not potent enough for effective treatment even after TCR or CAR redirection, forcing modification of allogeneic donor-derived T cells. However, the endogenous αβ T-cell receptor on infused allogeneic T cells may recognize major and minor histocompatibility antigens in the recipient, leading to graft-versus-host-disease (GVHD). As a result, the majority of current clinical trials using infusion of autologous CART cells rely on immune tolerance to prevent TCR-mediated deleterious recognition of normal tissues after adoptive cell transfer. This approach has achieved early clinical successes but is limited by the time and expense to manufacture patient-specific T-cell products. To solve this problem, compositions and methods for generating a modified T cell with a nucleic acid capable of altering gene expression of an endogenous gene selected from the group consisting of TCR α chain, TCR β chain, beta-2 microglobulin, a HLA molecule, CTLA-4, PD1, and FAS have been described. These approaches have been combined with knock-out of CD52 so as to make the allogeneic T cells resistant to CD52 targeted monoclonal alemtuzumab (Campath) while depleting the endogenous T cells, thereby preventing the rejection of allogeneic T cells and allowing their engraftment and expansion. However, the above approaches generally involve use of gene editing with CRISP/Cas9, Zn Finger nucleases or Talons, which have off-target effects. Further, the above approaches suffer from partial knock-out and the efficiency of knock-out is not high. In addition, if the above approaches have to be combined with CAR expression, then two separate processes have to be optimized, i.e., lentiviral transduction and electroporation with Cas9/CRISP, TALON and Zn finger nucleases etc. Finally, the above approaches result in permanent knock-out of the targeted gene. Therefore, a need exists for safer and potentially reversible methods of modifying T cells for allogeneic cellular therapies, while circumventing the use of gene editing system.

The disclosure provides compositions and methods for generating a modified immune cell (e.g., a T cell or NK cell) by expressing one or more antigen masking receptors capable of binding to and interfering with the function of one or more endogenous proteins. The T cells may be further modified to express a nucleic acid encoding an immune activating receptor, such as a chimeric antigen receptor, a synthetic immune receptor, an Ab-TCR, a TFP, a Tri-TAC, or a recombinant T cell receptor (TCR).

The disclosure provides compositions and methods for generating a modified immune cell (e.g., a T cell or NK cell) by expressing one or more antigen masking receptors capable of binding to and interfering with the function of one or more endogenous protein selected from but not limited to the group consisting of TCR α chain, TCR β chain, TCRγ, TCRδ, CD3ε, CD3δ, CD3ζ, CD3γ, beta-2 microglobulin, a HLA molecule, CTLA-4, PD1, FAS, TRAIL-R1 (DR4), TRAIL-R2 (DR5), and CD52. The T cells may be further modified to express a nucleic acid encoding an immune activating receptor, such as a chimeric antigen receptor, a synthetic immune receptor, an Ab-TCR, TFP, Tri-TAC or a recombinant T cell receptor (TCR).

The disclosure provides a modified immune cell (e.g., T cell or NK cell) comprising a nucleic acid encoding an antigen masking receptor capable of binding to and/or interfering with one or more of endogenous proteins selected from the group consisting of TCR α chain, TCR β chain, TCRγ, TCRδ, CD3ε, CD3δ, CD3ζ, CD3γ, beta-2 microglobulin, a HLA molecule, CTLA-4, PD1, FAS, TRAIL-R1 (DR4), TRAIL-R2 (DR5), and CD52.

In another aspect, the disclosure includes a method for generating a modified immune cell (e.g., T cell) comprising introducing a nucleic acid encoding one or more antigen masking receptors capable of binding to and/or interfering with one or more of endogenous proteins selected from the group consisting of TCR α chain, TCR β chain, TCRγ, TCRδ, CD3ε, CD3δ, CD3ζ, CD3γ, beta-2 microglobulin, a HLA molecule, CTLA-4, PD1, FAS, TRAIL-R1 (DR4), TRAIL-R2 (DR5), and CD52 into a T cell; and introducing a nucleic acid encoding a CAR, including next generation CAR (e.g., SIR, Ab-TCR, TFP, TRI-TAC and the like) or a modified T cell receptor (TCR).

In some embodiments, the engineered immune cells (e.g., T cells or CAR-T cells or SIR-T cells or Ab-TCR T cells or TFP-T cells or TRI-TAC T cells) target an antigen selected from the group of but not limited to one or more of the CD5; CD19; CD123; CD22; CD30; CD171; CS1 (also referred to as CD2 subset 1, CRACC, MPL, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac (2-8)aNeu5Ac(2-3)bDGa1p(1-4)bDG1cp(1-1)Cer); TNF receptor family member B cell maturation (BCMA); Tn antigen ((Tn Ag) or (Ga1NAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3)bDCla1p(l-4)bDG1cp(1-1) Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPlB 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGLl1, TCRgamma-delta, NKG2D, CD32 (FCGR2A), Tn ag, Tim1-/HVCR1, CSF2RA (GM-CSFR-alpha), TGFbetaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRC5D, Claudin18.2 (CLD18A2 or CLDN18A.2), P-glycoprotein, STEAP1, Liv1, Nectin-4, Cripto, gpA33, BST1/CD157, low conductance chloride channel, and the antigen recognized by TNT antibody.

In some embodiments, the engineered immune cells possess enhanced therapeutic efficacy as a result of reduced graft-versus-host disease (GvHD) in a host, reduced or elimination of rejection by a host, extended survival in a host, reduced inhibition by the tumor in a host, reduced self-killing in a host, reduced inflammatory cascade in a host, and/or sustained natural/artificial receptor-mediated (e.g., CAR-mediated) signal transduction in a host.

The disclosure provides a method of treating a disease (e.g., cancer, infectious, immune disorder) or condition in a subject comprising administering an effective amount of a pharmaceutical composition comprising the modified T or NK cell described herein to a subject in need thereof.

The disclosure provides a method for stimulating a T cell-mediated immune response to a target cell or tissue in a subject comprising administering to a subject an effective amount of a pharmaceutical composition comprising the modified T cell described herein.

The disclosure provides a method for adoptive cell transfer therapy comprising administering an effective amount of a pharmaceutical composition comprising the modified T cell described herein to a subject in need thereof to prevent or treat a cancer, infectious or an immune reaction that is adverse to the subject.

In yet another aspect, the disclosure includes a composition or pharmaceutical composition comprising the modified T and NK cell generated according to the method described herein.

In various embodiments of the above, the antigen masking receptor capable of binding to and/or interfering with one or more of endogenous proteins selected from the group consisting of TCR α chain, TCR β chain, TCRγ, TCRδ, CD3ε, CD3δ, CD3ζ, CD3γ, beta-2 microglobulin, a HLA molecule, CTLA-4, PD1, FAS, TRAIL-R1 (DR4), TRAIL-R2 (DR5), and CD52 comprises an antigen binding domain, a hinge domain, a transmembrane domain and an optional cytosolic domain.

In various embodiments of the above, the antigen masking receptor capable of binding to and/or interfering with one or more of endogenous proteins selected from the group consisting of TCR α chain, TCR β chain, TCRγ, TCRδ, CD3ε, CD3δ, CD3ζ, CD3γ, beta-2 microglobulin, a HLA molecule, CTLA-4, PD1, FAS, TRAIL-R1 (DR4), TRAIL-R2 (DR5), and CD52 comprises an antigen binding domain, a hinge domain, and a membrane anchoring domain.

In an embodiment, the AMR further carries a protein stabilization or a protein destabilization domain (e.g., FKBP12-F36V, FRB or Shieldtag domain) that can be used to regulate its expression at the post-translational level following the administration of a suitable ligand (e.g., dTAG-13 or Shield1, rapamycin or rapalogs etc). The protein stabilization and destabilization domain allows reversible control of the expression of the AMR. In some embodiments, the AMR-expressing cells are exposed to ligand in vitro. In other embodiments, the AMR-expressing cells are exposed to ligand in vivo, i.e., after administration to the host.

The methods described herein enable rapid removal or inactivation of specific proteins in immune cells redirected by a natural or artificial receptor, e.g., CARs, thus broadening the application potential and significantly improving the function of the engineered cells. The method relies, in part, on a single construct or multiple constructs containing an immune activating receptor, e.g., a CAR (which comprises an extracellular domain {e.g., an scFv) that binds to a specific target, a transmembrane domain, and a cytoplasmic domain) together with an antigen masking molecule that binds a target antigen {e.g., protein) to be removed or neutralized; the antigen masking molecule is linked to a domain that anchors it to the cell membrane.

As will be apparent from the teachings herein, a variety of immune activating receptors may be suitable for the methods of the disclosure. That is, any receptor that comprises a molecule that, upon binding (ligation) to a ligand (e.g., peptide or antigen) expressed on a cancer cell, is capable of activating an immune response may be used according to the present methods. For example, as described above, the immune activating receptor can be a chimeric antigen receptor (CAR); methods for designing and manipulating a CAR is known in the art (see, Geiger T L, et al, J Immunol. 1999;

162(10):5931-5939; Brentjens R J, et al, NatMed. 2003; 9(3):279-286; Cooper L J, et al, Blood. 2003; 101(4): 1637-1644). Additionally, receptors with antibody-binding capacity can be used {e.g., CD16-4-1BB-CD3zeta receptor—Kudo K, et al. Cancer Res. 2014; 74(1):93-103), which are similar to CARs, but with the scFv replaced with an antibody-binding molecule {e.g., CD16, CD64, CD32). Further, T-cell receptors comprising T-cell receptor alpha and beta chains that bind to a peptide expressed on a tumor cell in the context of the tumor cell HLA can also be used according to the present methods. In addition, other receptors bearing molecules that activate an immune response by binding a ligand expressed on a cancer cell can also be used—e.g., NKG2D-DAP10-CD3zeta receptor, which binds to NKG2D ligand expressed on tumor cells (see, e.g., Chang Y H, et al., Cancer Res. 2013; 73(6): 1777-1786). Finally, next generation CARs, such as SIR, Ab-TCR and TFP are included. All such suitable receptors collectively, as used herein, are referred to as an "immune activating receptor" or "immune receptor" or a "receptor that activates an immune response upon binding a cancer cell ligand." Therefore, an immune activating receptor having a molecule activated by a cancer cell ligand can be expressed together with an antigen masking receptor according to the present methods.

The methods and compositions of the disclosure significantly expand the potential applications of immunotherapies based on the infusion of immune cells redirected by artificial receptors. The method described is practical and can be easily incorporated in a clinical-grade cell processing. For example, a single bicistronic construct containing, e.g., a CAR and an antigen masking receptor (AMR) can be prepared by inserting an internal ribosomal entry site (IRES) or a 2A peptide-coding region site between the 2 cDNAs encoding the CAR and the AMR. The design of tricistronic delivery systems to delete more than one target should also be feasible. Alternatively, separate transductions of the 2 genes (simultaneously or sequentially) could be performed. In the context of cancer cell therapy, the CAR could be replaced by an antibody-binding signaling receptor (Kudo K, et al., Cancer Res. 2014; 74(1):93-103), a T-cell receptor directed against a specific HLA-peptide combination, or any receptor activated by contact with cancer cells (Chang Y H, et al., Cancer Res. 2013; 73(6): 1777-1786).

The AMR targeting CD3e, TCRa, TCRb1, TCRb2 described herein have the capability of stably downregulating CD3 and/or TCR expression. Residual CD3+ T cells could be removed using CD3 beads, an approach that is also available in a clinical-grade format. The capacity to generate CD3/TCR-negative cells that respond to CAR signaling represents an important advance. Clinical studies with CAR T cells have generally been performed using autologous T cells. Thus, the quality of the cell product varies from patient to patient and responses are heterogeneous. Infusion of allogeneic T cells is currently impossible as it has an unacceptably high risk of potentially fatal GvHD, due to the stimulation of the endogenous TCR by the recipient's tissue antigens. Downregulation of CD3/TCR opens the possibility of infusing allogeneic T cells because lack of endogenous TCR eliminates GvHD capacity. Allogeneic products could be prepared with the optimal cellular composition (e.g., enriched in highly cytotoxic T cells, depleted of regulatory T cells, etc.) and selected so that the cells infused have high CAR expression and functional potency. Moreover, fully standardized products could be cryopreserved and be available for use regardless of the patient immune cell status and his/her fitness to undergo apheresis or extensive blood draws. Removal of TCR expression has been addressed using gene editing tools, such as nucleases (Torikai H, et al. Blood, 2012; 119(24):5697-5705). Although this is an effective approach, it is difficult to implement in a clinical setting as it requires several rounds of cell selection and expansion, with prolonged culture. The methods described herein have considerable practical advantages.

An exemplary AMR that binds to human CD3e chain has an antigen binding domain, i.e., scFv, with amino acid sequence represented by SEQ ID NO: 6336. An exemplary AMRs that binds to CD3e and can be used to downregulate the expression of TCR/CD3 complex on allogeneic T cells (e.g., allogeneic CAR-T cells) is represented by SEQ ID NOs: 6586, 7336, 7586, 7836, 8086, 8336, 8586, 8836, and 9336.

An exemplary AMR that binds to human NKp46 receptor has an antigen binding domain, i.e., scFv, with amino acid sequence represented by SEQ ID NO: 6337. An exemplary AMRs that binds to NKp46 and can be used to downregulate the expression of NKp46 on allogeneic NK cells (e.g., allogeneic CAR-NK cells) is represented by SEQ ID NOs: 6587, 7337, 7587, 7837, 8087, 8337, 8587, 8837, and 9337.

Additionally, an AMR can be used according to the disclosure to mask HLA Class I molecules, reducing the possibility of rejection of allogeneic cells. While infusion of allogeneic T cells is a future goal of CAR T cell therapy, infusion of allogeneic natural killer (NK) cells is already in use to treat patients with cancer. A key factor that determines the success of NK cell-based therapy is that NK cells must persist in sufficient numbers to achieve an effector: target ratio likely to produce tumor cytoreduction (Miller J S. Hematology Am Soc Hematol Educ Program. 2013; 2013: 247-253). However, when allogeneic cells are infused, their persistence is limited. Immunosuppressive chemotherapy given to the patient allows transient engraftment of the infused NK cells but these are rejected within 2-4 weeks of infusion (Miller J S, et al. Blood. 2005; 105:3051-3057; Rubnitz J E, et al., J Clin Oncol. 2010; 28(6):955-959). Contrary to organ transplantation, continuing immunosuppression is not an option because immunosuppressive drugs also suppress NK cell function. Because rejection is primarily mediated by recognition of HLA Class I molecules by the recipient's $CD8^{+}$ T lymphocytes, masking HLA Class I molecules on the infused NK cells (or T cells) will diminish or abrogate the rejection rate, extend the survival of allogeneic cells, and hence their anti-tumor capacity.

An exemplary AMR that binds to beta2 microglobulin (B2M) and can be used to downregulate expression of HLA molecules on immune cells to diminish or abrogate the rejection rate, extend the survival of allogeneic cells, and hence their anti-tumor capacity has an antigen binding domain, i.e., scFv, with amino acid sequence represented by SEQ ID NO: 6339. An exemplary AMRs that binds to B2M is represented by SEQ ID NOs: 7089, 7339, 7589, 7839, 8089, 8339, 8589, 8839, and 9339.

An exemplary AMR that binds to HLA-A2 and can be used to downregulate expression of HLA-A2 molecules on immune cells to diminish or abrogate the rejection rate, extend the survival of allogeneic cells, and hence their anti-tumor capacity has an antigen binding domain, i.e., scFv, with amino acid sequence represented by SEQ ID NO: 6219. An exemplary AMRs that binds to HLA-A2 is represented by SEQ ID NOs: 6469, 6969, 7219, 7719, 7969, 8219, 8469, 8719, 8969 and 9219.

Furthermore, an AMR of the disclosure can be used to mask expression of CD52 to make the allogeneic T cells resistant to CD52 targeted monoclonal alemtuzumab (Campath) while depleting the endogenous T cells, thereby preventing the rejection of allogeneic T cells and allowing their engraftment and expansion.

Furthermore, an AMR can be used according to the disclosure to target inhibitory receptors. Specifically, administration of antibodies that release T cells from inhibitory signals such as anti-PD1 or anti-CTLA-4 have produced dramatic clinical responses (Sharma P, et al., Nat Rev Cancer. 2011; 11(11):805-812; Pardoll D M. Nat Rev Cancer. 2012; 12(4):252-264). CAR-T cells, particularly those directed against solid tumors, might be inhibited by similar mechanisms. Thus, expression of an AMR {e.g., scFv or ligands) against PD1, CTLA-4, Tim3 or other inhibitory receptors would prevent the expression of these molecules and sustain CAR-mediated signal transduction. In NK cells, examples of inhibitory receptors include killer immunoglobulin-like receptors (KIRs) and NKG2A (Vivier E, et al., Science, 2011; 331(6013):44-49).

The methods and compositions of the disclosure also enable targeting of a greater number of targets amenable for CAR-directed T cell therapy. One of the main limitations of CAR-directed therapy is the paucity of specific antigens expressed by tumor cells. In the case of hematologic malignancies, such as leukemias and lymphomas, molecules which are not expressed in non-hematopoietic cells could be potential targets but cannot be used as CAR targets because they are also expressed on T cells and/or NK cells. Expressing such CARs on immune cells would likely lead to the demise of the immune cells themselves by a "fratricidal" mechanism, nullifying their anti-cancer capacity. If the target molecule can be masked on immune cells without adverse functional effects, then the CAR with the corresponding specificity can be expressed. This opens many new opportunities to target hematologic malignancies. Examples of the possible targets include CD38 expressed in multiple myeloma, CD7 expressed in T cell leukemia and lymphoma, Tim-3 expressed in acute leukemia, CD30 expressed in Hodgkin disease, CD45 and CD52 expressed in all hematologic malignancies. These molecules are also expressed in a substantial proportion of T cells and NK cells.

Moreover, it has been shown that secretion of cytokines by activated immune cells triggers cytokine release syndrome and macrophage activation syndrome, presenting serious adverse effects of immune cell therapy (Lee D W, et al, Blood. 2014; 124(2): 188-195). Thus, the AMR molecule can be used according to the disclosure to block cytokines such as IL-6, IL-2, IL-4, IL-7, IL-10, IL-12, IL-15, IL-18, IL-21, IL-27, IL-35, interferon (IFN)-γ, IFN-β, IFN-a tumor necrosis factor (TNF)-a, TRAIL, and transforming growth factor (TGF)-, which may contribute to such inflammatory cascade.

Accordingly, in one embodiment, the disclosure provides an engineered immune cell that comprises a nucleic acid comprising a nucleotide sequence encoding an immune activating receptor, and a nucleic acid comprising a nucleotide sequence encoding an AMR.

The disclosure also provides a method of purification of viral vectors expressing an ABR (e.g., a CAR, TFP etc.) or any other cell surface expressed protein. The method entails affinity chromatography using an agent capable of binding the ABR (e.g., a CAR, TFP etc.) or the cell surface expressed protein or a fragment thereof (e.g., an epitope tag). In an exemplary embodiment, a lentiviruses or γ-retroviruses encoding a CD19 ABR (e.g., a CAR, TFP etc.) can be purified by affinity chromatography using Protein L, a soluble CD19 receptor, an anti-idiotype antibody directed against the scFv comprising the antigen binding domain of the ABR (e.g., a CAR, TFP etc.) using methods known in the art.

The disclosure also provides a method of detection and/or quantitation of viral vectors expressing an ABR (e.g., a CAR, TFP etc.) or any other cell surface expressed protein. The method entails using an agent capable of binding the ABR (e.g., a CAR, TFP etc.) or the cell surface expressed protein or a fragment thereof (e.g., an epitope tag). In an exemplary embodiment, a lentiviruses or γ-retroviruses encoding a CD19 ABR (e.g., a CAR, TFP etc.) can be detected and/or quantitated by, for example, ELISA using Protein L-HRP, a soluble CD19 receptor-Fc-HRP, an HRP conjugated anti-idiotype antibody directed against the scFv comprising the antigen binding domain of the ABR (e.g., a CAR, TFP etc.) or a HRP-conjugated goat anti-human Fab antibody (in case the antigen binding domain of the ABR (e.g., a CAR, TFP etc.) is comprised of a human antibody) or a HRP-conjugated goat-anti-mouse Fab antibody (in case the antigen binding domain of the CAR is comprised of a mouse antibody).

As demonstrated herein, viral vector, such as lentiviral, γ retroviral, AAV etc., are used for gene transfer application. A major problem in the field is the lack of a simple assay for quantitation of titers of the viral vectors. Although ELISA based assays are frequently used for measuring the titers of lentiviral vectors, they are cumbersome, expensive, time consuming and require multiple incubation and wash steps.

The disclosure provides a simple, highly sensitive solution to the above problem. The solution entails expression of a reporter gene/protein in the packaging cell lines that are used for the packaging of the viral vector so that the encoded reporter protein gets incorporated in the virus particles. In one embodiment, the reporter gene encodes for any one or more of a luciferase, fluorescent protein, alkaline phosphatase or any other protein that can be easily measured. In an exemplary embodiment, the reporter is a firefly luciferase, a marine luciferase (e.g., NLuc, Gluc, TurboLuc16, MLuc7 etc), a fluorescent protein (e.g., Green Fluorescent Protein or GFP, YFP, CFP, mCherry, morange etc.), an alkaline phosphatase (e.g., secretory alkaline phosphatase).

In an embodiment, the reporter protein is thermostable at 37° C., 38° C., 39° C. or 40° C. In another embodiment, the reporter protein is stable in serum. In yet another embodiment, the reporter protein has serum half-life at 37° C. that is more than 2 hours, 4 hours, 6 hours, 8 hours, 10 hours, 12 hours, 24 hours, 36 hours, 48 hours or 72 hours.

In an embodiment, the reporter is any one or more of GLuc, NLuc, MLuc7, HTLuc, PaLuc1, PaLuc2, MpLuc1, McLuc1, MaLuc1, MoLuc1, MoLuc2, MLuc39, PsLuc1, LoLuc1-3, HtLuc2, TurboLuc16 (TLuc), *Renilla* Luc, Firefly luciferase (FfLuc or Fluc), LucPPe-146-1H2, LucPPe-133-1B2, LucPPe-78-0B10, LucPPe49-7C6A, LucPpL-81-6G1 or CBGRluc or homologs or orthologs or mutants or derivatives thereof.

In an embodiment, the reporter gene/protein is expressed in the cytosol of the cells used to produce the vector; i.e., packaging cells. In an embodiment, the reporter gene/protein is expressed on the cell membranes of the packaging cells that are used to produce the viral vector. In an embodiment, the reporter gene/protein comprises a signal peptide. In an embodiment, the reporter gene/protein comprises a transmembrane domain. In an embodiment, the reporter gene/protein comprises a membrane anchoring domain (e.g, a GPI linker domain).

In one embodiment, the reporter is expressed in the packaging cells stably. In another embodiment, the reporter gene is expressed in the packaging cells transiently. In still another embodiment, the reporter is expressed using a mammalian expression vector. Exemplary vectors include pCDNA3 or pCDNA3.1 (Invitrogen). In one embodiment, the reporter is expressed using a mammalian expression vector that also express one or more genes needed for the packaging of the viral vectors. In yet another embodiment, the reporter is expressed using a mammalian expression vector that also express the viral envelop gene. In an embodiment, the reporter is expressed using a mammalian expression vector that also express the VSVG gene. In another embodiment, the reporter is expressed using a mammalian expression vector that also express the Amphopac envelop gene. In still another embodiment, the reporter is expressed using a mammalian expression vector that also express the Ecopac envelop gene. In another embodiment, the reporter is expressed using a mammalian expression vector that also express the gag and pol genes. In another embodiment, the reporter is expressed in the Phoenix packaging cell line.

In one embodiment, the disclosure is based on the finding that it is possible to incorporate a reporter into a retroviral or lentiviral particles. In one embodiment, the disclosure involves including a reporter transmembrane or membrane anchored protein in the producer or packaging cell, which get(s) incorporated into the retrovirus when it buds from the producer/packaging cell membrane. The reporter transmembrane/membrane anchored protein is expressed as a separate cell surface molecule on the producer cell rather than being part of the viral envelope glycoprotein. This means that the reading frame of the viral envelope is unaffected, which therefore preserves functional integrity and viral titre.

The disclosure provides a retroviral or lentiviral vector having a viral envelope which comprises: (i) a reporter transmembrane/membrane anchored protein which comprises a reporter domain and a transmembrane/membrane anchoring domain; and/or wherein the reporter transmembrane/membrane anchored protein is not part of a viral envelope glycoprotein. The retroviral or lentiviral vector may comprise a separate viral envelope glycoprotein, encoded by an env gene. Thus there is provided a retroviral or lentiviral vector having a viral envelope which comprises: (i) a viral envelope glycoprotein: and (ii) a reporter transmembrane/membrane anchored protein having the structure: R-S-TM, in which R is a reporter domain; S is an optional spacer and TM is a transmembrane domain.

In one embodiment, the reporter transmembrane/membrane anchored protein are not part of the viral envelope glycoprotein. They exist as separate proteins in the viral envelope and are encoded by separate genes. In another embodiment, the reporter transmembrane/membrane anchored protein protein may have the structure: R-S-TM, in which R is a reporter domain; S is an optional spacer and TM is a transmembrane domain.

The reporter transmembrane/membrane anchored protein could be detected by any means known in the art, such as luminescence, fluorescence etc.

The viral vector may comprise two or more reporter transmembrane/membrane anchored proteins in the viral envelope. For example, the viral vector may comprise a first reporter transmembrane/membrane anchored protein which encodes for NLuc and a second reporter transmembrane/membrane anchored protein which encodes for EGFP.

The reporter transmembrane/membrane anchored protein may carry epitope tags (e.g., StrepTag, Flag tag, Myc Tag, His-Tag etc.) to aid in the purification of the viral particles.

The viral vector may comprise additional cytokine-based T-cell activating transmembrane protein may, for example, comprise a cytokine selected from IL2, IL7 and IL15.

There is also provided a retroviral or lentiviral vector having a viral envelope which comprises a reporter transmembrane/membrane anchored protein.

The viral vector may comprise a heterologous viral envelope glycoprotein giving a pseudotyped viral vector. For example, the viral envelope glycoprotein may be derived from RD114 or one of its variants, VSV-G, Gibbon-ape leukaemia virus (GALV), or is the Amphotropic envelope, Measles envelope or baboon retroviral envelope glycoprotein.

In another embodiment, the viral envelope of the viral vector may in addition to the reporter transmembrane/membrane anchored protein also comprise a tagging protein which comprises: a binding domain which binds to a capture moiety, a spacer; and a transmembrane domain, wherein the tagging protein facilitates purification of the viral vector from cellular supernatant via binding of the tagging protein to the capture moiety. The binding domain of the tagging protein may comprise one or more streptavidin-binding epitope(s). The streptavidin-binding epitope(s) may be a biotin mimic, such as a biotin mimic which binds streptavidin with a lower affinity than biotin, so that biotin may be used to elute streptavidin-captured retroviral vectors produced by the packaging cell. Examples of suitable biotin mimics include: Streptagll, Flankedccstretag and ccstreptag.

The viral vector comprises a nucleic acid sequence encoding a T-cell receptor or a chimeric antigen receptor or similar ABR construct. In one embodiment, the viral vector may be a virus-like particle (VLP).

In another embodiment, the disclosure provides a host cell which expresses, at the cell surface, a reporter transmembrane/membrane anchored protein comprising a reporter domain and a transmembrane domain such that a retroviral or lentiviral vector produced by the packaging cell comprises an ABR coding sequence and a lipid envelop comprising the reporter domain.

In another embodiment, the host cell may also express, at the cell surface: a tagging protein which comprises: a binding domain which binds to a capture moiety; and a transmembrane domain, which tagging protein facilitates purification of the viral vector from cellular supernatant via binding of the tagging protein to the capture moiety. The tagging protein may also comprise a spacer between the binding domain and the transmembrane domain.

The term host cell may be a packaging cell or a producer cell. A packaging cell may comprise one or more of the following genes: gag, pol, env and/or rev. A producer cell comprises gag, pol, env and optionally rev genes and also comprises a retroviral or lentiviral genome. In this respect, the host cell may be any suitable cell line stably expressing reporter transmembrane/membrane anchored proteins. It may be transiently transfected with transfer vector, gagpol, env (and rev in the case of a lentivirus) to produce replication incompetent retroviral/lentiviral vector.

The disclosure also provides a method for making a host cell comprising transducing or transfecting a cell with a nucleic acid encoding a reporter transmembrane/membrane anchored protein.

The disclosure also provides a method for producing a viral vector comprising expressing a retroviral or lentiviral genome in a cell transduced or transfectedl with a nucleic acid encoding a reporter transmembrane/membrane anchored protein.

The disclosure provides a method for measuring the titer of a retroviral or lentiviral vector, the method comprising the steps of measuring the activity of the reporter. In one embodiment, the activity of the reporter is measured by addition of a substrate. Exemplary substrates include coelentrazine and luciferine etc.

The disclosure also provides a kit for making a retroviral or lentiviral vector comprising a report construct, which comprises: a host cell transduced or transfected with a nucleic acid encoding a reporter transmembrane/membrane anchored protein; nucleic acids comprising gag, pol, env and optionally rev; and a retroviral genome.

There is also provided a kit for measuring the titer of the retrovirus or lentivirus particle according to the disclosure, which comprises measuring the activity of the reporter transmembrane/membrane anchoring protein incorporated in the viral particles by methods known in the art. In one embodiment, the method involves the steps of 1) addition of a substrate suitable for the reporter; and 2) measuring the activity of the reporter. In one embodiment, the activity of the reporter is measured using a luminometer, an absorbance reader, a fluorescence reader or a flow cytometer.

The disclosure therefore provides a viral vector with a built-in reporter for measurement of its titer. The vector has the capability to both allow measurement of titer and to also effect gene insertion. This has a number of advantages: (1) it simplifies the process of viral vector (e.g., retrovirus, lentivirus etc.) production and measurement of titer. (2) it reduces the time needed for measurement of vector titer (e.g., retrovirus, lentivirus etc.); (3) it reduces the cost of measuring retrovirus, lentivirus titer; (4) the assay for measuring the viral vector (e.g., retrovirus, lentivirus etc.,) titer is extremely sensitive; (5) the assay for measuring the viral vector (e.g., retrovirus, lentivirus etc.,) titer does not require expensive equipment; (6) the assay for measuring the viral vector (e.g., retrovirus, lentivirus etc.,) titer can be completed in a single step; (7) the assay for measuring the viral vector (e.g., retrovirus, lentivirus etc.,) titer can be performed on crude preparation of the viral vector; (7) the reporter does not affect the function of the viral vector (e.g., its ability to get packaged or its ability to transduce the target cells etc.).

Since the reporter (e.g., reporter transmembrane/membrane anchoring protein) is provided on a molecule which is separate from the viral envelope glycoprotein, integrity of the viral envelope glycoprotein is maintained and there is no negative impact on viral titre.

The viral vectors of the disclosure are capable of delivering a nucleotide of interest (NOI) to a target cell, such as a T cell or a natural killer (NK) cell. The NOI may encode all or part of a T-cell receptor (TCR), a chimeric antigen receptor (CAR), including next generation CARs (e.g., SIR, Ab-TCR, TFP, TRI-TAC etc.), antigen masking receptors, therapeutic controls (e.g., tEGFR, tBCMA etc.), accessory modules (e.g., PDL1, PDL2, CD80, CD86, K13, MC159, NEMO-K270A etc.) and/or a suicide gene. A suicide gene encodes a polypeptide which enable the cells expressing such a polypeptide to be deleted, for example by triggering apoptosis. An example of a suicide gene is described in WO2013/153391.

The disclosure provides a host cell which expresses a reporter protein. In one embodiment, the reporter protein is expressed at the cell surface. In one embodiment, the reporter protein is expressed at the cell surface as a transmembrane protein. In one embodiment, the reporter protein is expressed at the cell surface as a membrane anchored protein (e.g., GPI linked protein). In one embodiment, the reporter protein is expressed in the cytosol.

The host cell is used for the production of viral vectors. The host cell may be a packaging cell and comprise one or more of the following genes: gag, pol, env and rev. A packaging cell for a retroviral vector may comprise gag, pol and env genes. A packaging cell for a lentiviral vector may comprises gag, pol, env and rev genes.

The host cell may be a producer cell and comprise gag, pol, env and optionally rev genes and a retroviral or lentiviral vector genome.

The packaging cells of the disclosure may be any mammalian cell type capable of producing retroviral/lentiviral vector particles. The packaging cells may be 293T-cells, or variants of 293T-cells which have been adapted to grow in suspension and grow without serum.

The viral vector of the disclosure may comprise a reporter protein. A reporter protein is any protein or protein fragment whose activity can be easily measured. Exemplary reporter proteins are listed in Table 19 and 20. In some embodiments, the reporter protein may be a cytosolic protein. In some embodiments, the reporter protein may be captured in the virus particles. In some embodiments, the reporter protein may be attached to the viral envelope. In some embodiments, the reporter protein may be a transmembrane or membrane anchored protein. In some embodiments, the reporter protein is derived from the host cell during retroviral vector production. The reporter protein is made by the packaging cell and expressed in the cytosol or at the cell surface. When the nascent retroviral vector buds from the host cell membrane, the reporter protein is incorporated in the viral envelope as part of the packaging cell-derived lipid bilayer. In another embodiment, the reporter protein is packaged inside the viral envelope.

The term "host-cell derived" indicates that the reporter protein is derived from the host cell as described above and is not produced as a fusion or chimera from one of the viral genes, such as gag, which encodes the main structural proteins; or env, which encodes the envelope protein.

The reporter proteins may comprise one of the sequences listed in SEQ ID Nos: 12055-12082, 12084-12113, 12115-12144 and 12146-12175 or variants thereof.

The reporter transmembrane protein/membrane anchored proteins may comprise a variant of the sequence shown as SEQ ID No. 12084-12113, 12115-12144 and 12146-12175 having at least 80, 85, 90, 95, 98 or 99% sequence identity, provided that the variant sequence is a reporter protein having the required properties i.e., the capacity to serve as a reporter, to not interfere with the assembly (e.g., budding) or the viral vector or its ability to transduce the target cells.

The reporter protein may have the structure: R-S-TM, in which R is a reporter domain; S is an optional spacer domain and TM is a transmembrane domain or membrane anchoring domain.

The reporter protein may be expressed in the cytosol without a transmembrane or spacer domain. SEQ ID NO of exemplary cytosolic expressed reporter proteins are listed in SEQ ID NO: 12055-12082 (Table 19).

The reporter domain is the part of the reporter protein which allows its activity to be measured in a suitable assay. The reporter domain may be an enzymatic domain, e.g., a catalytic domain. The reporter domain may be a domain that produce fluorescence or luminescence.

The reporter protein may comprise a spacer sequence to connect the reporter domain with the transmembrane domain. A flexible spacer allows the reporter domain to orient in different directions and facilitate folding. The spacer sequence may, for example, comprise an lgG1 Fc region, an lgG1 hinge or a human CD8 stalk or the mouse CD8 stalk. The spacer may alternatively comprise an alternative linker sequence which has similar length and/or domain spacing properties as an lgG1 Fc region, an lgG1 hinge or a CD8 stalk. A human lgG1 spacer may be altered to remove Fc binding motifs. The spacer sequence may be derived from a human protein. The spacer sequence may not be derived from a viral protein. In particular, the spacer sequence may not be, be derived from, or comprise part of the surface envelope subunit (SU) of a retroviral env protein.

The transmembrane domain is the sequence of the reporter protein that spans the membrane. The transmembrane domain may comprise a hydrophobic alpha helix. The transmembrane domain may be derived from CD28 or CD8. The transmembrane domain may be derived from a human protein. The transmembrane domain may not be derived from a viral protein. In particular, the transmembrane domain may not be, be derived from, or comprise part of the transmembrane envelope subunit (TM) of a retroviral env protein. An alternative option to a transmembrane domain is a membrane-targeting domain such as a GPI anchor.

GPI anchoring is a post-translational modification which occurs in the endoplasmic reticulum. Preassembled GPI anchor precursors are transferred to proteins bearing a C-terminal GPI signal sequence. During processing, the GPI anchor replaces the GPI signal sequence and is linked to the target protein via an amide bond. The GPI anchor targets the mature protein to the membrane. The reporter protein may comprise a GPI signal sequence.

The disclosure also relates to a nucleic acid encoding a reporter protein. The nucleic acid may be in the form of a construct comprising a plurality of sequences encoding a reporter protein.

The disclosure also provides a vector, or kit of vectors which comprises one or more sequences encoding a reporter protein. Such a vector may be used to introduce the nucleic acid sequence(s) into a host cell, such as a producer or packaging cell. The vector may, for example, be a plasmid or synthetic mRNA. The vector may be capable of transfecting or transducing a host cell.

The disclosure also provides a method of measuring the titer of a viral vector, e.g., a retroviral or lentiviral vector, by measuring the activity of the reporter protein. In one embodiment, the reporter protein is a membrane anchored NLuc fusion protein and the viral vector titer is measured by adding the NLuc substrate (e.g., coelentrazine) to the viral particles and measuring the production of light by a luminometer. The step may further comprise comparing the Nluc activity of a test vector with the Nluc activity of a control viral vector whose viral titer has been previously determined using methods known in the art, such as by p24 ELISA or by infection of a susceptible cell line and measuring the number of infected cells.

Also provided is a kit for measuring the titer of a viral vector using the methods of the disclosure. The kit may contain suitable vectors encoding the reporter protein, packaging plasmids (e.g., plasmids encoding gag, pol, rev and env etc.), transfer vector, substrate (e.g., coelentrazine), packaging cell line, and instructions manual.

As used herein, an "engineered" immune cell includes an immune cell that has been genetically modified as compared to a naturally-occurring immune cell. For example, an engineered T cell produced according to the present methods carries a nucleic acid comprising a nucleotide sequence that does not naturally occur in a T cell from which it was derived. In some embodiments, the engineered immune cell of the disclosure includes a chimeric antigen receptor (CAR) and a AMR. In a particular embodiment, the engineered immune cell of the disclosure includes an anti-CD19-4-1BB-CD3ζ CAR and an anti-CD3 AMR. In certain embodiments, the engineered immune cell is an engineered T cell, an engineered natural killer (NK) cell, an engineered NK/T cell, an engineered monocyte, an engineered macrophage, or an engineered dendritic cell.

In certain embodiments, an immune activating receptor binds to molecules expressed on the surface of tumor cells, including but not limited to, CD20, CD22, CD33, CD2, CD3, CD4, CD5, CD7, CD8, CD45, CD52, CD38, CS-1, TIM3, CD123, mesothelin, folate receptor, HER2-neu, epidermal-growth factor receptor, and epidermal growth factor receptor. In some embodiments, the immune activating receptor is a CAR (e.g., anti-CD19-4-1BB-CD3 CAR). In certain embodiments, the immune activating receptor comprises an antibody or antigen-binding fragment thereof (e.g., scFv) that binds to molecules expressed on the surface of tumor cells, including but not limited to, CD20, CD22, CD33, CD2, CD3, CD4, CD5, CD7, CD8, CD45, CD52, CD38, CS-1, TIM3, CD123, mesothelin, folate receptor, HER2-neu, epidermal-growth factor receptor, and epidermal growth factor receptor.

In another embodiment, modified T cell described herein further comprises an exogenous nucleic acid encoding a costimulatory molecule, such as CD3, CD27, CD28, CD83, CD86, CD127, 4-1BB, 4-1BBL, PD1 and PD1L. In one embodiment, the method of generating the modified T cell described herein further comprises electroporating a RNA encoding a co-stimulatory molecule into the T cell. In some embodiments where the costimulatory molecule is CD3, the CD3 comprises at least two different CD3 chains, such as CD3 zeta and CD3 epsilon chains.

In another embodiment, the T cell is obtained from the group consisting of peripheral blood mononuclear cells, cord blood cells, a purified population of T cells, tissue resident T cells, marrow resident mononuclear cells, mobilized T cells, artificial T cells, iPSC-derived T cells and a T cell line.

In yet another embodiment, the method of generating the modified T cell as described herein further comprises expanding the T cell. In one embodiment, expanding the T cell comprises electroporating the T cell with RNA encoding a chimeric membrane protein and culturing the electroporated T cell.

In still another embodiment, the method of generating the modified T cell as described herein further comprising cryopreserving the T cell. In another embodiment, the method described herein further comprises thawing the cryopreserved T cell prior to introducing the nucleic acid into the T cell.

In one embodiment, introducing the nucleic acid is selected from the group consisting of transducing the expanded T cells, transfecting the expanded T cells, and electroporating the expanded T cells.

In yet another embodiment, the method described herein further comprises expressing Klf4, Oct3/4 and Sox2 in the T cells to induce pluripotency of the T cell.

In various embodiments of the above, the disclosure includes administering the modified T cell to a subject. In one embodiment, the subject has a condition, such as an autoimmune disease. In some embodiments, the autoimmune disease is selected from the group consisting of Acquired Immunodeficiency Syndrome (AIDS), alopecia areata, ankylosing spondylitis, antiphospholipid syndrome, autoimmune Addison's disease, autoimmune hemolytic anemia, autoimmune hepatitis, autoimmune inner ear disease (AIED), autoimmune lymphoproliferative syndrome (ALPS), autoimmune thrombocytopenic purpura (ATP), Behcet's disease, cardiomyopathy, celiac sprue-dermatitis hepetiformis; chronic fatigue immune dysfunction syndrome (CFIDS), chronic inflammatory demyelinating polyneuropathy (CIPD), cicatricial pemphigold, cold agglutinin disease, crest syndrome, Crohn's disease, Degos' disease, dermatomyositis-juvenile, discoid lupus, essential mixed cryoglobulinemia, fibromyalgia-fibromyositis, Graves' disease, Guillain-Barre syndrome, Hashimoto's thyroiditis, idiopathic pulmonary fibrosis, idiopathic thrombocytopenia purpura (ITP), IgA nephropathy, insulin-dependent diabetes mellitus, juvenile chronic arthritis (Still's disease), juvenile rheumatoid arthritis, Meniere's disease, mixed connective tissue disease, multiple sclerosis, myasthenia gravis, pernacious anemia, polyarteritis *nodosa*, polychondritis, polyglandular syndromes, polymyalgia rheumatica, polymyositis and dermatomyositis, primary agammaglobulinemia, primary biliary cirrhosis, psoriasis, psoriatic arthritis, Raynaud's phenomena, Reiter's syndrome, rheumatic fever, rheumatoid arthritis, sarcoidosis, scleroderma (progressive systemic sclerosis (PSS), also known as systemic sclerosis (SS)), Sjogren's syndrome, stiff-man syndrome, systemic lupus erythematosus, Takayasu arteritis, temporal arteritis/giant cell arteritis, ulcerative colitis, uveitis, vitiligo, Wegener's granulomatosis, and any combination thereof. In another embodiment, the condition is a cancer, such as a cancer selected from the group consisting of breast cancer, prostate cancer, ovarian cancer, cervical cancer, skin cancer, pancreatic cancer, colorectal cancer, renal cancer, liver cancer, brain cancer, lymphoma, MDS, leukemia, lung cancer, and any combination thereof.

In another embodiment, the method described herein further comprises inducing lysis, such as antibody-dependent cell-mediated cytotoxicity (ADCC), of the target cell or tissue.

The major barrier to allogeneic cellular therapies (e.g., CAR-T cell therapy, SIR-T cell therapy, TIL, TCR therapy), hematopoietic transplantation, organ transplantation between genetically non-identical patients lies in the recipient's immune system, which can respond to the transplanted cell and/or organ as "non-self" and reject it. Thus, having medications to suppress the immune system is essential, however, suppressing an individual's immune system places that individual at greater risk of infection and cancer, in addition to the side effects of the medications. A number of immunosuppressive drugs, including a calcineurin inhibitor such as cyclosporine A, tacrolimus or sirolimus; prednisone; and an inhibitor of nucleic acid synthesis such as mycophenolate mofetil, are used to suppress the host immune response. These drugs have side effects that include hypertension, nephrotoxicity, infection, and heart disease that contribute to long term patient disability and graft loss. In spite of modern immunosuppressive drugs, in some centers acute rejection can occur in 10-25% of people after transplant.

Another frequent problem in adoptive cellular therapy is the lack of persistence of the adoptive transferred cells. This problem is seen in the case of both autologous and allogeneic cells.

While use of allogeneic T cells offer significant advantages for adoptive cellular therapy, such cells are prone to rejection by the host immune system. The present disclosure provides solutions to the problem of lack of persistence of both autologous and allogeneic adoptively transferred cells. The present disclosure also provides solutions to the problem of rejection of allogeneic adoptively transferred cells (e.g., CAR-T, SIR-T, TIL, TCR-T etc), allogeneic hematopoietic stem cell transplantation and organ transplantation. In one embodiment, the solution entails suppressing the cellular and humoral immune response targeted against the adoptively transferred autologous and allogeneic cells. In one embodiment, the solution entails suppressing the cellular and humoral immune response targeted against the adoptively transferred cells (e.g., allogeneic cells, e.g., allogeneic CAR-T cells or allogeneic stem cells or allogeneic kidney cells etc.). In one embodiment, the solution entails promoting the exhaustion of the host immune cells that are reactive against the adoptively transferred cells (e.g., allogeneic cells, e.g., allogeneic CAR-T cells or allogeneic stem cells or allogeneic kidney cells etc). In one embodiment, the solution entails promoting the conversion of host immune cells that are reactive against the adoptively transferred cells (e.g., allogeneic cells, e.g., allogeneic CAR-T cells or allogeneic stem cells or allogeneic kidney cells etc.) into TREG cells. In one embodiment, the solution entails promoting the death of host immune cells that are reactive against the adoptively transferred cells (e.g., allogeneic cells, e.g., allogeneic CAR-T cells or allogeneic stem cells or allogeneic kidney cells etc.).

In one embodiment, the disclosure provides compositions and methods that stimulate signaling via the immune checkpoint receptor and/or inhibitory immune receptors expressed on the host immune cells when they encounter the adoptively transferred cells (e.g., allogeneic cells, e.g., allogeneic CAR-T cells or allogeneic stem cells or allogeneic kidney cells etc.). Exemplary immune checkpoint receptors include PD1 and CTLA4. In one embodiment, the disclosure provides compositions and methods that stimulate signaling via the immune checkpoint receptors PD1 and/or CTLA4 that are expressed on the host immune cells when they encounter the adoptively transferred cells (e.g., allogeneic cells, e.g., allogeneic CAR-T cells or allogeneic stem cells or allogeneic kidney cells etc.). In one embodiment, the disclosure provides compositions and methods that stimulate signaling via the immune checkpoint receptors PD1 and/or CTLA4 that are expressed on the host immune cells by exogenous expression of PD1- and/or CTLA-4 binding agents on the adoptively transferred cells (e.g., allogeneic cells, e.g., allogeneic CAR-T cells or allogeneic stem cells or allogeneic kidney cells etc.). Stated another way, the exogenous agent is "engineered" to be expressed in a cell. An exogenous agent may be a cloned or recombinant version of a naturally occurring agent. The term "exogenous expression" or "non-natural expression" as used herein refers to expression of a gene or a protein that is not expressed in the cells naturally or is expressed naturally at a lower level. In one embodiment, the PD1- and/or CTLA-4 binding agents that are exogenously expressed on the adoptively transferred cells (e.g., allogeneic cells, e.g., allogeneic CAR-T cells or allogeneic stem cells or allogeneic kidney cells etc.) activate signaling via PD1 and/or CTLA-4 that are expressed on the host immune cells. In exemplary embodiment, the PD1- and/or CTLA-4 binding agents that are exogenously expressed on the adoptively transferred cells (e.g., allogeneic cells, e.g., allogeneic CAR-T cells or allogeneic stem cells or allogeneic kidney cells etc.) inhibit the activation of host immune cells. In exemplary embodiment, the PD1 and/or CTLA-4 binding agents that are exogenously expressed on the adoptively transferred cells (e.g., allogeneic cells, e.g., allogeneic CAR-T cells or allogeneic stem cells or allogeneic kidney cells etc.) inhibit cytotoxic activity of the host immune cells. In exemplary embodiment, the PD1 and/or CTLA-4 binding agents that are exogenously expressed on the adoptively transferred cells (e.g., allogeneic cells, e.g., allogeneic CAR-T cells or allogeneic stem cells or allogeneic kidney cells etc.) inhibit production of immune activating cytokines (e.g., IFNγ and/or TNFα) by the host immune cells. In exemplary embodiment, the PD1 and/or CTLA-4 binding agents that are exogenously expressed on the adoptively transferred cells (e.g., allogeneic cells, e.g., allogeneic CAR-T cells or allogeneic stem cells or allogeneic kidney cells etc.) inhibit production of IFNγ and/or TNFα by the host immune cells. In exemplary embodiment, the PD1 and/or CTLA-4 binding agents that are exogenously expressed on the adoptively transferred cells (e.g., allogeneic cells, e.g., allogeneic CAR-T cells or allogeneic stem cells or allogeneic kidney cells etc.) induce exhaustion of the host immune cells. In an embodiment, the PD1 and/or CTLA-4 binding agents that are exogenously expressed on the adoptively transferred cells (e.g., allogeneic cells, e.g., allogeneic CAR-T cells or allogeneic stem cells or allogeneic kidney cells etc.) induce tolerance in the host immune cells. In an embodiment, the PD1 and/or CTLA-4 binding agents that are exogenously expressed on the adoptively transferred cells (e.g., allogeneic cells, e.g., allogeneic CAR-T cells or allogeneic stem cells or allogeneic kidney cells etc.) induce differentiation of the host immune cells into TREG cells. In an embodiment, the PD1 and/or CTLA-4 binding agents that are exogenously expressed on the adoptively transferred cells (e.g., allogeneic cells, e.g., allogeneic CAR-T cells or allogeneic stem cells or allogeneic kidney cells etc.) prevent their rejection by the host immune cells. In an embodiment, the PD1 and/or CTLA-4 binding agents that are exogenously expressed on the adoptively transferred cells (e.g., allogeneic cells, e.g., allogeneic CAR-T cells) promote their long term persistence in the host.

In an exemplary embodiment, the immune checkpoint receptor and/or immune inhibitory receptor binding agent is a membrane anchored polypeptide (MAP) that is exogenously expressed on the surface of the adoptively transferred cells (e.g., allogeneic cells, e.g., allogeneic CAR-T cells) and binds to immune checkpoint receptor and/or immune inhibitory receptors expressed on the host immune cells.

In an exemplary embodiment, the immune checkpoint receptor and/or immune inhibitory receptor binding agent is a membrane anchored polypeptide (MAP) that is exogenously expressed on the surface of the adoptively transferred cells (e.g., allogeneic cells, e.g., allogeneic CAR-T cells) and binds to PD1 expressed on the host immune cells. The MAP may optionally contain protein stabilization or destabilization tags, such as dTAG and ShieldTag that allow the control of its activity by addition of appropriate ligand of the tag. In an exemplary embodiment, the PD1 binding agent is a MAP that binds to PD1 expressed on the host immune cells and inhibits the activation of the host immune cells. In an exemplary embodiment, the PD1 binding agent is a MAP that binds to and activates PD1 expressed on the host immune cells. In an exemplary embodiment, the PD1 binding agent is an AMR that binds to PD1 expressed on the host immune cells and inhibits the activation of the host immune cells. In an exemplary embodiment, the PD1 binding agent is an MAP that does not bind in cis to PD1 expressed on the adoptively transferred cells (e.g., allogeneic cells, e.g., allogeneic CAR-T cells). In an exemplary embodiment, the PD1 binding agent is a MAP that does not activate signaling via PD1 expressed on the adoptively transferred cells (e.g., allogeneic cells, e.g., allogeneic CAR-T cells). In an exemplary embodiment, the adoptively transferred cells (e.g., allogeneic cells, e.g., allogeneic CAR-T cells) expressing the PD1 binding agent (e.g., MAP) lack the expression of PD1. In an exemplary embodiment, the adoptively transferred cells (e.g., allogeneic cells, e.g., allogeneic CAR-T cells) expressing the PD1 binding agent (e.g., MAP) lack the expression of PD1 due to suppression and/or elimination of the endogenous PD1 gene or protein. In exemplary embodiments, the expression of PD1 on adoptively transferred cells (e.g., allogeneic cells, e.g., allogeneic CAR-T cells) is suppressed and/or eliminated using techniques known in the art, such as use of siRNA/shRNA, gene editing systems (e.g., CRISP/Cas9, Talons, Zn finger nucleases etc.) and antigen masking receptors (AMR).

In an exemplary embodiment, the PD1 binding agent is encoded by the human PDL1/CD274/PDCD1LG1 gene (Gene ID: 29126) or an isoform, homolog, ortholog or variant thereof. The nucleic acid and amino acid sequences of an exemplary PDL1/CD274 gene and protein are provided in SEQ ID NO: 72 and SEQ ID NO: 5958, respectively.

In an exemplary embodiment, the PD1 binding agent is encoded by the human PDL2/CD273/PDCD1LG2 gene (Gene ID: 80380) or an isoform, homolog, ortholog or variant thereof. The nucleic acid and amino acid sequences of an exemplary PDL2/CD273 gene and protein are provided in DNA SEQ ID NO: 73 and PRT SEQ ID NO: 5959, respectively.

In an exemplary embodiment, the PD1 binding agent is an agent that bears more than 80%, 85%, 90%, 95% amino acid sequence homology to the PD1-binding region of human PDL1/CD274 protein. In an exemplary embodiment, the PD1 binding agent is an agent that bears more than 80%, 85%, 90%, 95% amino acid sequence homology to the PD1-binding region of human PDL2 protein.

In an embodiment, the PD1 binding agent lacks a cytosolic signaling domain or have a mutant signaling domain. Exemplary PD1-binding agents that lack cytosolic signaling domains include deletion mutants of PDL1 and PDL2 proteins that lack their cytosolic signaling domains.

In an exemplary embodiment, a PD1-binding agent comprises a PD1-binding domain derived from an antibody, an antibody fragment, a scFv, a vHH, a single domain antibody, a vL, a vH, or a non-immunoglobulin antigen binding domain. In an exemplary embodiment, a PD1-binding agent is an agonist agent, i.e., it activates signaling via PD1. In an exemplary embodiment, a PD1-binding agent is an agonist antibody, an agonist antibody fragment, an agonist scFv, an agonist vHH, an agonist single domain antibody, an agonist vL, an agonist vH, or an agonist non-immunoglobulin antigen binding domain.

The amino acid sequences of exemplary scFvs that bind to PD1 and that can be used in the generation of a MAP of the disclosure are represented by SEQ ID NOs: 11865, 11880 and 11895. The amino acid sequences of exemplary MAPs that can bind to PD1 are represented by SEQ ID NOs: 11878, 11893 and 11908. The nucleic acid SEQ IDs of other constructs encoding MAPs that can bind to PD1 are represented by SEQ ID NOs: 11826-11832, 11841-11847, 11856-11862 (Table 7). The amino acid SEQ IDs of other constructs encoding MAPs that can bind to PD1 are represented by SEQ ID NOs: 11871-11877, 11886-11892, 11901-11907 (Table 7).

In an exemplary embodiment, the immune checkpoint receptor and/or immune inhibitory receptor binding agent is a membrane anchored polypeptide (MAP) that is exogenously expressed on the surface of the adoptively transferred cells (e.g., allogeneic cells, e.g., allogeneic CAR-T cells or allogeneic stem cells or allogeneic kidney cells etc.) and binds to CTLA4 expressed on the host immune cells. The MAP may optionally contain protein stabilization or destabilization tags, such as dTAG and ShieldTag that allow the control of its activity by addition of appropriate ligand of the tag. In an exemplary embodiment, the CTLA4-binding agent is a MAP that binds to CTLA4 expressed on the host immune cells and inhibits the activation of the host immune cells. In an exemplary embodiment, the CTLA4 binding agent is a MAP that binds to and activates CTLA4 expressed on the host immune cells. In an exemplary embodiment, the CTLA4 binding agent is an AMR that binds to CTLA4 expressed on the host immune cells and inhibits the activation of the host immune cells. In an exemplary embodiment, the CTLA4-binding agent is an MAP that does not bind in cis to CTLA4 expressed on the adoptively transferred cells (e.g., allogeneic cells, e.g., allogeneic CAR-T cells). In an exemplary embodiment, the CTLA4 binding agent is a MAP that does not activate signaling via CTLA4 expressed on the adoptively transferred cells (e.g., allogeneic cells, e.g., allogeneic CAR-T cells or allogeneic stem cells or allogeneic kidney cells etc.). In an exemplary embodiment, the adoptively transferred cells (e.g., allogeneic cells, e.g., allogeneic CAR-T cells or allogeneic stem cells or allogeneic kidney cells etc.) expressing the CTLA4 binding agent (e.g., MAP) lack the expression of CTLA4. In an exemplary embodiment, the adoptively transferred cells (e.g., allogeneic cells, e.g., allogeneic CAR-T cells) expressing the CTLA4 binding agent (e.g., MAP) lack the expression of CTLA4 due to suppression and/or elimination of the endogenous CTLA4 gene or protein. In exemplary embodiments, the expression of CTLA4 on adoptively transferred cells (e.g., allogeneic cells, e.g., allogeneic CAR-T cells) is suppressed and/or eliminated using techniques known in the art, such as use of siRNA/shRNA, gene editing systems (e.g., CRISP/Cas9, Talons, Zn finger nucleases etc.) and antigen masking receptors (AMR).

In an exemplary embodiment, the CTLA4 binding agent is encoded by the human gene CD80 (Gene ID: 941) or an isoform, homolog, ortholog or variant thereof. The nucleic acid and amino acid sequences of an exemplary CD80 gene and protein are provided in SEQ ID NO: 71 and SEQ ID NO: 5957, respectively.

In an exemplary embodiment, the CTLA4 binding agent is encoded by the human gene CD86 (Gene ID: 942) or an isoform, homolog, ortholog or variant thereof. The nucleic acid and amino acid sequences of an exemplary CD86 gene and protein are provided in SEQ ID NO: 79 and SEQ ID NO: 5965, respectively.

In another embodiment, the immune checkpoint receptor and/or immune inhibitory receptor binding agent binds to an immune inhibitory receptor selected from the group of TIM3, LAG3, VISTA, BTLA, TIGIT, LAIR-1, CD160, 2B4, TGFR beta, CEACAM-1, CEACAM-3, CEACAM-5 and an NK cell inhibitory receptor.

In another embodiment, the MAP targets an immune inhibitory receptor selected from the group of TIM3, LAG3, VISTA, BTLA, TIGIT, LAIR-1, CD160, 2B4, TGFR beta, CEACAM-1, CEACAM-3, CEACAM-5 and an NK cell inhibitory receptor.

In one embodiment, the disclosure provides compositions and methods that increase the expression or activity of one or more genes from the group of PDL1 (DNA SEQ ID NO: 72 and PRT SEQ ID NO: 5958), PDL2 (DNA SEQ ID NO: 73 and PRT SEQ ID NO: 5959), and/or an inhibitor of death receptor induced cell death, such as MC159 (SEQ ID NO:76), dominant-negative mutant of FADD (DNA SEQ ID NO: 74 and PRT SEQ ID NO: 5960), dominant negative mutant of Caspase 8, crmA (DNA SEQ ID NO: 77 and PRT SEQ ID NO: 5963) and p35 (DNA SEQ ID NO: 78 and PRT SEQ ID NO: 5964). In other embodiment, the method consists of ectopic expression of an anti-apoptotic protein, such as Bcl2, BclxL and Mcl-1.

The disclosure further provides a vector comprising sequence encoding PDL-1 (e.g., DNA SEQ ID NO: 72 and PRT SEQ ID NO: 5958), PDL2 (DNA SEQ ID NO: 73 and PRT SEQ ID NO: 5959), a MAP targeting PD1 (e.g., SEQ ID NO: 11826-11833, 11841-11848, 11856-11863), CD80 (SEQ ID NO: 71), CD86 (SEQ ID NO: 79), a MAP targeting CTLA4 and/or an inhibitor of death receptor induced cell death, such as MC159 (SEQ ID NO: 76), dominant negative mutant of FADD (DNA SEQ ID NO: 74 and PRT SEQ ID NO: 5960), dominant negative mutant of Caspase 8, crmA (DNA SEQ ID NO: 77 and PRT SEQ ID NO: 5963) and p35 (DNA SEQ ID NO: 78 and PRT SEQ ID NO: 5964).

The disclosure further provides a vector comprising sequence encoding an immune receptor and a sequence encoding PDL-1 (e.g., DNA SEQ ID NO: 72 and PRT SEQ ID NO: 5958), PDL2 (DNA SEQ ID NO: 73 and PRT SEQ ID NO: 5959), a MAP targeting PD1 (e.g., SEQ ID NO: 11826-11833, 11841-11848, 11856-11863), CD80 (SEQ ID NO: 71), CD86 (SEQ ID NO: 79), a MAP targeting CTLA4 and/or an inhibitor of death receptor induced cell death, such as MC159 (SEQ ID NO: 76), dominant negative mutant of FADD (DNA SEQ ID NO: 74 and PRT SEQ ID NO: 5960), dominant negative mutant of Caspase 8, crmA (DNA SEQ ID NO: 77 and PRT SEQ ID NO: 5963) and p35 (DNA SEQ ID NO: 78 and PRT SEQ ID NO: 5964).

Methods to exogenously express immune receptors (e.g., CAR, SIR etc.) and accessory modules, such as PDL1, PDL2, CD80, CD86, MAPs, MC159, crmA and p35 are well known in the art. In one embodiment, the sequence encoding an immune receptor and sequence encoding PDL1, PDL2, crmA, p35, MC159 are encoded on a single vector and are separated by a 2A sequence. In one embodiment, the immune receptor and PDL1, PDL2, CD80, CD86, crmA, p35, and MC159 are encoded on separate vectors.

The disclosure also provides cells exogenously expressing PDL1, PDL2, CD80, CD86, MAP (e.g., MAP targeting PD1, CTLA4 etc.), MC159, crmA and/or p35. In some embodiments, the cells are immune cells (e.g., T cells, NK cells, NKT cells etc.). In some embodiment, the cells are hematopoietic cells. In some embodiments, the cells are obtained from a cord blood. In some embodiments, the cells are peripheral blood stem cells while in other embodiments, the cells are bone marrow derived stem cells. In some embodiments, the cells are immune cells (e.g., T cells, NK cells, NKT cells etc.) that are derived from hematopoietic stem cells or induced pluripotent stem cells. In other embodiment, the cells are non-hematopoietic cells (e.g., kidney cells, liver cells, skin cells, heart cells, pancreas cells, lung cells etc.). In some embodiments, the cells are stem cells, e.g., hematopoietic stem cells, induced pluripotent stem cells (iPSC), embryonic stem cells etc. In some embodiments, the cells are obtained from HLA-matched donor, e.g., a donor that is matched with the recipient at the HLA-A, -B, -C, -DRB1, and -DQB1 loci (10/10 match). In some embodiments, the cells are obtained from HLA-mismatched donor. In some embodiments, the cells are obtained from HLA haploidentical donor. In some embodiments, the cells are obtained from a related donor, while in other embodiments the cells are obtained from an unrelated donor.

The disclosure also provides a therapeutic composition comprising a cell (e.g., allogeneic cells, e.g., allogeneic CAR-T cells or allogeneic stem cells or allogeneic kidney cells etc.) exogenously expressing PDL1, PDL2, CD80, CD86, MAP (e.g., MAP targeting PD1, CTLA4 etc.), MC159, crmA and/or p35.

The disclosure also provides a therapeutic composition comprising a cell (e.g., allogeneic cells, e.g., allogeneic CAR-T cells or allogeneic stem cells or allogeneic kidney cells etc.) exogenously expressing an immune receptor and an accessory module comprising PDL1, PDL2, CD80, CD86, MAP (e.g., MAP targeting PD1, CTLA4 etc.), MC159, crmA and/or p35.

The disclosure also provides a method of extending the life span of transplanted cells (e.g., allogeneic cells, e.g., allogeneic CAR-T cells or allogeneic stem cells or allogeneic kidney cells etc.) and/or organs (e.g., kidney, liver, heart, lung, pancreas etc.) by exogenously expressing in such cells and/or organs PDL1, PDL2, CD80, CD86, MAP (e.g., MAP targeting PD1, CTLA4 etc.), MC159, crmA and/or p35.

In some embodiments, the cells (e.g., immune cells) exogenously expressing PDL1, PDL2, MC159, crmA and/or p35 also express one or more chimeric or recombinant receptors (e.g., CAR, SIR, CTCR, Ab-TCR, TFP, Tri-TAC, recombinant TCR etc.).

In some embodiments, the immune cells exogenously expressing PDL1, PDL2, CD80, CD86, MAP (e.g., MAP targeting PD1, CTLA4 etc.), MC159, crmA and/or p35 express an immune receptor comprising an antigen binding domain that targets an antigen selected from the group of but not limited to CD5; CD19; CD123; CD22; CD30; CD171; CS1 (also referred to as CD2 subset 1, CRACC, MPL, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3) bDGa1p(1-4)bDG1cp(1-1)Cer); TNF receptor family member B cell maturation (BCMA); Tn antigen ((Tn Ag) or (Ga1NAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3) bDCla1p(1-4)bDG1cp(1-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCTA-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPlB 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGLl1, TCRgamma-delta, NKG2D, CD32 (FCGR2A), Tn ag, Tim1-/HVCR1, CSF2RA (GM-CSFR-alpha), TGF-betaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRC5D, Claudin18.2 (CLD18A2 or CLDN18A.2), P-glycoprotein, STEAP1, Liv1, Nectin-4, Cripto, gpA33, BST1/CD157, low conductance chloride channel, and the antigen recognized by TNT antibody.

In some embodiments, the cells (e.g., immune cells, e.g., allogeneic immune cells, e.g., allogeneic T cells) exogenously expressing PDL1, PDL2, CD80, CD86, MAP (e.g., MAP targeting PD1, CTLA4 etc.), MC159, crmA and/or p35 also express one or more antigen masking receptors targeting one or more of endogenous proteins selected from the group consisting of TCR α chain, TCR β chain, TCRγ, TCRδ, CD3ε, CD3δ, CD3ζ, CD3γ, beta-2 microglobulin, a HLA molecule, CTLA-4, PD1, FAS, TRAIL-R1 (DR4), TRAIL-R2 (DR5), and CD52.

An exemplary AMR that is designed to bind to CD52 and may be used to protect immune cells (e.g., T cells, e.g., CAR-T cells) from cytotoxicity of a CD52 antibody (e.g., CAMAPATH) has an antigen binding domain, i.e., scFv, with nucleic sequence represented by SEQ ID NO: 444 and amino acid sequence represented by SEQ ID NO: 6330. An exemplary AMRs that is designed to bind to CD52 is represented by SEQ ID NOs: 694, 944, 1194, 1444, 1694, 1944, 2194, 2444 or 2694.

In some embodiments, the cells (e.g., immune cells, e.g., allogeneic immune cells, e.g., allogeneic T cells) exogenously expressing PDL1, PDL2, CD80, CD86, MAP (e.g., MAP targeting PD1, CTLA4 etc.), MC159, crmA and/or p35 also express a gene editing system targeting one or more of endogenous genes selected from the group consisting of TCR α chain, TCR β chain, TCRγ, TCRδ, CD3ε, CD3δ, CD3ζ, CD3γ, beta-2 microglobulin, a HLA molecule, CTLA-4, PD1, FAS, TRAIL-R1 (DR4), TRAIL-R2 (DR5), and CD52.

In some embodiments, the cells (e.g., immune cells, e.g., allogeneic immune cells, e.g., allogeneic T cells) exogenously expressing PDL1, PDL2, CD80, CD86, MAP (e.g., MAP targeting PD1, CTLA4 etc.), MC159, crmA and/or p35 also have disruption or knock-down of one or more of endogenous genes selected from the group consisting of TCR α chain, TCR β chain, TCRγ, TCRδ, CD3ε, CD3δ, CD3ζ, CD3γ, beta-2 microglobulin, a HLA molecule, CTLA-4, PD1, FAS, TRAIL-R1 (DR4), TRAIL-R2 (DR5), and CD52.

The disclosure also provides a method of treating a disease condition by administration to a subject cells and/or organs and/or tissues (e.g., allogeneic immune cells, e.g., allogeneic CAR-T cells, hematopoietic stem cells, kidney, pancreas, liver etc.) exogenously expressing PDL1, PDL2, CD80, CD86, MAP (e.g., MAP targeting PD1, CTLA4 etc.), MC159, crmA and/or p35.

In some embodiments, the subject receiving the adoptively transferred cells is further administered a CD52 targeting agent, e.g., a CD52 antibody, e.g., Alemtuzumab (Campath). In some embodiment, the CD52 targeting agent is administered before, concurrent with and/or after the administration of the adoptively transferred cells (e.g., immune cells, e.g., CAR-T cells).

In some embodiments, the method involves administration to the subject, receiving the cells of the disclosure (i.e., allogeneic cells exogenously expressing PDL1, PDL2, CD80, CD86, MAP (e.g., MAP targeting PD1, CTLA4 etc.), MC159, crmA and/or p35), a CD40 antagonist. Exemplary CD40 antagonists include an antibody against CD40L, an antibody against CD40, a soluble CD40 receptor or a CD40-Fc fusion protein. In some embodiments, the CD40 antagonist is administered prior to the administration of the adoptively transferred cells, organs or tissues. In some embodiments, the CD40 antagonist is administered after the administration of the adoptively transferred cells, organs or tissues. In some embodiments, the CD40 antagonist is administered concurrent with the administration of the adoptively transferred cells, organs or tissues. In an embodiment, the CD40 antagonist is a CD40L antibody (e.g., BG9588). In an embodiment, BG9588 is administered at a dose of about 20 mg/kg (e.g., 10 mg/kg, 15 mg/kg, 25 mg/kg, 50 mg/kg, 100 mg/kg) by IV infusion about once every 14 days. In an embodiment, the CD40L is Dapirolizumab pegol (DZP). In an embodiment, the CD40 antagonist is Recombinant Human CD40/TNFRSF5 Fc Chimera (R&D Systems).

In some embodiment, the method involves administration to the subject receiving the cells of the disclosure total lymphoid irradiation. The irradiation may be fractionated or unfractionated. In the case that a recipient is treated with more than one dose of irradiation, all doses may be fractionated. In another case that a recipient is treated with more than one dose of irradiation, all doses may be unfractionated. In another case that a recipient is treated with more than one dose of irradiation, the doses may be a mix of fractionated unfractionated.

In some cases, the irradiation is delivered intraoperatively. In some cases, the irradiation is delivered intravenously. In some cases, the irradiation is delivered intraarterially. In some cases, the irradiation is delivered subcutaneously. In some cases, the irradiation is delivered intraperitoneally.

In some cases, a method for transplantation of an HLA-mismatched cell/organ (e.g., allogeneic immune cells, e.g., allogeneic CAR-T cells; e.g., PDL1 or PDL2 exogenously expressing CAR-T cells) from a donor comprising implanting the HLA-mismatched cell/organ from the donor in a recipient human body, treating the recipient with non-myeloablative conditioning, infusing the recipient with an engineered hematopoietic cell composition comprising at least $1\times10^6$ $CD34^+$ cells/kg and at least $1.0\times10^7$ $CD3^+$ cells/kg, and maintaining the recipient on an immunosuppressive regimen for a period of time sufficient to develop mixed chimerism for at least six months is disclosed.

In some cases, the methods may include infusing at least $10\times10^6$ $CD34^+$ cells/kg recipient weight and at least $1.0\times10^6$ $CD3^+$ cells/kg into the recipient. In some cases, at least $10\times10^6$ $CD34^+$ cells/kg recipient weight and at least $1.0\times10^7$ $CD3^+$ cells/kg are infused into the recipient. In some cases, at least $10\times10^6$ $CD34^+$ cells/kg recipient weight and between 1.0-$5.0\times10^6$ $CD3^+$ cells/kg are infused into the recipient. In some cases, less than $15\times10^6$ $CD34^+$ cells/kg recipient weight and at least $50\times10^6$ $CD3^+$ cells/kg are infused into the recipient. In some embodiments, the CD34+ cells or CD3+ cells are allogeneic cells exogenously expressing one or more of PDL1, PDL2, CD80, CD86, MAP (e.g., MAP targeting PD1, CTLA4 etc.), MC159, crmA and/or p35. In some embodiment, the CD3+ cells exogenously express an immune receptor, such as a CAR, SIR, Ab-TCR, TFP or TCR, etc.

In another embodiment, the method described herein further comprises inducing lysis, such as antibody-dependent cell-mediated cytotoxicity (ADCC), of the target cell or tissue.

The disclosure also relates to compositions and methods for amelioration, treatment and prevention of immune therapies related diseases or disorders, e.g., cytokine release syndrome and CRES caused by immune therapies, such as immune effector cell therapies (e.g., CAR-T) and T/NK cell activating antibodies, are disclosed.

Treatment with CARs and immune cell-targeted bispecific antibodies (e.g., Blinatumomab) are associated with a number of immunological adverse effects, such as CRS and CRES (neurotoxicity). A contributing factor to these complications is uncontrolled proliferation and activation of the immune cells (e.g., CAR-T cells or T cells exposed to T cell activating bispecific antibodies or NK cells exposed to NKp46-bispecific NK cell engagers) when exposed to the target cells expressing their cognate antigen. Although a number of techniques have been described to control the activation and proliferation of adoptively transferred immune cells or immune cell targeted antibodies, they are usually not reversible and lack the ability to fine tune to the activity of the cells. The newer T cell activating bispecific antibodies have a very long half-lives and therefore their effect on T cell activation and proliferation are not easily reversible after administration. The disclosure overcomes this problem via the administration of an immune modulating agent (IMA or agent) that interferes with the interaction between the immune effector cells (e.g., CAR-T cells or T cells exposed to bispecific/multispecific antibodies or NK cells exposed to NKp46-bispecific NK cell engagers etc.) and the target antigen (e.g., CD19, CD20 etc.) or the target antigen expressing cells (e.g., cancer cells).

In one aspect the disclosure relates to an IMA for use in a method in the amelioration, treatment or prophylaxis of immunological adverse effects caused by immune therapies, such as cell therapies (e.g., CAR-T) and immune cell activating therapies (e.g., Bispecific T cell engagers or bispecific NK cell engagers). Also, the disclosure provides a method of amelioration, treatment or prophylaxis of immunological adverse effects caused by an immune therapy, said method comprising administering to a patient in need thereof an IMA. The IMA is typically administered in an amount which is sufficient to ameliorate, treat or prevent said immunological adverse effects caused by an immune therapy, such as a cell therapy (e.g., CAR-T) and immune cell activating therapy (e.g., Bispecific T cell engagers or bispecific NK cell engagers).

In one embodiment, the IMA competes with the immune effector cells (e.g., T cells, CAR-T cells, SIR-T cells, Ab-TCR-T cells, recombinant TCR T cells or T cells exposed to bispecific/multispecific antibodies or, NK cells, or NK cells exposed to NK cell activating bispecific engagers etc.) for binding to the target antigen. In another embodiment, the IMA competes with the immune cell activating bispecific/multispecific antibody or immune cell activating antibody fragment or immune cell activating non-immunoglobulin antigen binding scaffold for binding to the target antigen. In an embodiment, the binding affinity of the IMA for the target antigen is at least equal to or typically more than the binding affinity of the antigen binding domain of the immune effector cells (e.g., CAR-T cells) or the immune cell activating bispecific/multispecific agent (e.g., antibody, antibody fragment, scFv or non-immunoglobulin antigen binding domain). In an exemplary embodiment, the IMA is a scFV targeting CD19 (e.g., SEQ ID NO: 6091) that competes with T cells expressing a CD19 CAR (e.g., SEQ ID NO: 7341) or T cell exposed to a CD19×CD3 bispecific T cell activating antibody (e.g., Blinatumomab) or a CD19×CD3 bispecific centyrin for binding to the CD19 antigen expressed on the target cells (e.g., CD19 expressing leukemia or lymphoma cells or CD19-expressing normal B cells). The nucleic acid and amino acid SEQ ID NOs of several scFv targeting different antigens are provided in SEQ ID NO (DNA): 205-453, 11820, 11835, 11850 and SEQ ID NO (PRT): 6091-6339, 11865, 11880, 11895 of Table 7. The nucleic acid and amino acid SEQ ID NOs of several His-tagged scFv targeting different antigens are provided in SEQ ID NO (DNA): 705-953, 11822, 11837, 11852 and SEQ ID NO (PRT): 6591-6839, 11867, 11882, 11897 of Table 8. The order of these His-tagged scFv and their target antigen is the same as the order of scFv shown in Table 7. In an exemplary embodiment, the IMA is a scFV targeting CD19 that has higher affinity for CD19 as compared to CD19 CAR-T cells or a CD19×CD3 bispecific T cell activating antibody (e.g., Blinatumomab) or a CD19×CD3 bispecific centyrin. In an exemplary embodiment, the IMA is a scFV targeting CD19 that has higher affinity for CD19 and shorter serum half-life as compared to CD19 CAR-T cells or a CD19×CD3 bispecific T cell activating antibody (e.g., Blinatumomab) or a CD19×CD3 bispecific centyrin.

In another embodiment, the IMA binds to the immune effector cells (e.g., CAR-T cells or T cells exposed to bispecific/multispecific antibodies or NK cells, or NK cells exposed to NK cell activating bispecific engagers etc) and competes with the target cells expressing the antigen bound by the immune effector cells for binding to the immune effector cells. In an embodiment, the binding affinity of the IMA for the target antigen (e.g., CD3 or NKp46) expressed on the immune effector cells (e.g., T cell or NK cells) is at least equal to or typically more than the binding affinity of the immune cell activating bispecific/multispecific agent (e.g., antibody, antibody fragment, scFv or non-immunoglobulin antigen binding domain). In an exemplary embodiment, the IMA is a scFv or a centyrin or a vHH domain that binds to CD3 (e.g., CD3e chain) and competes with a CD19×CD3 bispecific T cell activating antibody (e.g., Blinatumomab) or a CD19×CD3 bispecific centyrin for binding to the CD3. In an embodiment, a CD3-binding IMA binds to CD3 (e.g., CD3e chain) without activating T cell, e.g., without activating signaling via the T cell receptor complex. In another embodiment, a CD3-binding IMA binds to CD3 (e.g., CD3e chain) and inhibits T cell, e.g., inhibits signaling via the T cell receptor complex. In an exemplary embodiment, the IMA is a scFV targeting CD3 that has higher affinity for CD3 as compared to a CD19×CD3 bispecific T cell activating antibody (e.g., Blinatumomab) or a CD19×CD3 bispecific centyrin. In an exemplary embodiment, the IMA is a scFV targeting CD3 that has higher affinity for CD3 and shorter serum half-life as compared to a CD19×CD3 bispecific T cell activating antibody (e.g., Blinatumomab) or a CD19×CD3 bispecific centyrin. The nucleic acid and amino acid sequences of scFv targeting CD3 are presented in SEQ ID NO: 446 and 450 and SEQ ID NO: 6332 and 6336, respectively (Table 7). The nucleic acid and amino acid SEQ ID NOs of several His-tagged scFv targeting different antigens are provided in SEQ ID NO (DNA): 946 and 950 and SEQ ID NO (PRT): 6832 and 6836.

In another exemplary embodiment, the IMA is a scFv or a centyrin or a vHH domain that binds to NKp46 and competes with a CD19×NKp46 bispecific NK cell activating antibody or a CD19×NKp46 bispecific centyrin for binding to the NKp46. In an embodiment, a NKp46-binding IMA binds to NKp46 without activating NK cell, e.g., without activating signaling via the NKp46 cell receptor complex. In another embodiment, a NKp46-binding IMA binds to NKp46 and inhibits NK cell, e.g., inhibits signaling via the NKp46 cell receptor complex. In an exemplary embodiment, the IMA is a scFV targeting NKp46 that has higher affinity for NKp46 as compared to a CD19×NKp46 bispecific NK cell activating antibody or a CD19×NKp46 bispecific centyrin. In an exemplary embodiment, the IMA is a scFV targeting NKp46 that has higher affinity for NKp46 and shorter serum half-life as compared to a CD19×NKp46 bispecific NK cell activating antibody or a CD19×NKp46 bispecific centyrin. The nucleic acid and amino acid sequences of scFv targeting NKp46 are presented in SEQ ID NO: 451 and SEQ ID NO: 6337, respectively (Table 7). The nucleic acid and amino acid SEQ ID NOs of His-tagged scFv targeting NKp46 are provided in SEQ ID NO (DNA): 951 and SEQ ID NO (PRT): 6837.

In an embodiment, the IMA is (1) an antibody; (2) an antibody fragment (e.g. a Fv, a Fab, a (Fab')2); (3) a heavy chain variable region of an antibody (vH domain) or a fragment thereof; (4) a light chain variable region of an antibody (vL domain) or a fragment thereof; (5) a single chain variable fragment (scFv) or a fragment thereof; (6) a single domain antibody (SDAB) or a fragment thereof; (7) a camelid VHH domain or a fragment thereof; (8) a monomeric variable region of an antibody; (9) a non-immunoglobulin antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; (10) a soluble receptor or ligand; and/or (11) any other molecule that binds to the target antigen.

In an exemplary embodiment, the IMA is a scFv fragment having the vL and vH fragments that have amino acid sequences which are identical to or bear more than 90% sequence homology to the vL and vH fragments of the antigen binding domain of the CAR or the T-cell activating bispecific/multispecific antibody or an NK cell activating bispecific/multispecific antibody. In an exemplary embodiment, the IMA is a scFv fragment having the CDRs (complement determining regions) of the vL and vH fragments that have amino acid sequences which are identical to or bear more than 90% sequence homology to the CDRs of vL and vH fragments of the antigen binding domain of the CAR or the T/NK-cell activating bispecific/multispecific antibody. In an exemplary embodiment, the IMA is a scFv fragment that binds to the same or overlapping epitope of an antigen as bound by the CAR or the T/NK-cell activating bispecific/multispecific antibody.

In an exemplary embodiment, the IMA is an antibody fragment (e.g. a Fv, a Fab, a (Fab')2) having the vL and vH fragments that have amino acid sequences which are identical to or bear more than 90% sequence homology to the vL and vH fragments of the antigen binding domain of the CAR or the T/NK-cell activating bispecific/multispecific antibody. In an exemplary embodiment, the IMA is an antibody fragment (e.g. a Fv, a Fab, a (Fab')2) having the CDRs (complement determining regions) of the vL and vH fragments that have amino acid sequences which are are identical to or bear more than 90% sequence homology to the CDRs of vL and vH fragments of the antigen binding domain of the CAR or the T/NK-cell activating bispecific/multispecific antibody. In an exemplary embodiment, the IMA is an antibody fragment (e.g. a Fv, a Fab, a (Fab')2) that binds to the same or overlapping epitope of an antigen as bound by the CAR or the T/NK-cell activating bispecific/multispecific antibody.

In an exemplary embodiment, the IMA is a centyrin that has amino acid sequence which is identical to or bear more than 90% sequence homology to the antigen binding domain of the CAR or the T/NK-cell activating bispecific/multispecific antibody. In an exemplary embodiment, the IMA is a centyrin that binds to the same and/or competing epitope of an antigen as bound by the antigen binding domain of the CAR or the T/NK-cell activating bispecific/multispecific antibody.

In an exemplary embodiment, the IMA is a vHH domain that has amino acid sequence which is identical to or bear more than 90% sequence homology to the antigen binding domain of the CAR or the T/NK-cell activating bispecific/multispecific antibody. In an exemplary embodiment, the IMA is a vHH domain that binds to the same and/or competing epitope of an antigen as bound by the antigen binding domain of the CAR or the T/NK-cell activating bispecific/multispecific antibody.

In an exemplary embodiment, the IMA is a non-immunoglobulin antigen binding scaffold that has amino acid sequence which is identical to or bear more than 90% sequence homology to the antigen binding domain of the CAR or the T/NK-cell activating bispecific/multispecific antibody. In an exemplary embodiment, the IMA is a non-immunoglobulin antigen binding scaffold that binds to the same and/or competing epitope of an antigen as bound by the antigen binding domain of the CAR or the T/NK-cell activating bispecific/multispecific antibody.

In an exemplary embodiment, the IMA is a scFv fragment having the vL and vH fragments that have amino acid sequences which are identical to bear more than 90% sequence homology to the vL and vH fragment of the CD3 binding domain of a T-cell activating bispecific/multispecific antibody. In an exemplary embodiment, the IMA is a scFv fragment having the CDRs (complement determining regions) of the vL and vH fragments that have amino acid sequences which are identical to or bear more than 90% sequence homology to the CDRs vL and vH fragment of the antigen binding domain of a T-cell activating bispecific/multispecific antibody. In an exemplary embodiment, the IMA is a scFv fragment that binds to the same or overlapping epitope of CD3 as bound by the T-cell activating bispecific/multispecific antibody.

In an exemplary embodiment, the IMA is an antibody fragment (e.g. a Fv, a Fab, a (Fab')2) having the vL and vH fragments that have amino acid sequences which are identical to or bear more than 90% sequence homology to the vL and vH fragment of the CD3 binding domain of a T-cell activating bispecific/multispecific antibody. In an exemplary embodiment, the IMA is an antibody fragment (e.g. a Fv, a Fab, a (Fab')2) having the CDRs (complement determining regions) of the vL and vH fragments that have amino acid sequences which are identical to or bear more than 90% sequence homology to the CDRs vL and vH fragment of the CD3 binding domain of a T-cell activating bispecific/multispecific antibody. In an exemplary embodiment, the IMA is an antibody fragment (e.g. a Fv, a Fab, a (Fab')2) that binds to the same or overlapping epitope of CD3 as bound by a T-cell activating bispecific/multispecific antibody.

In an exemplary embodiment, the IMA is a centyrin has amino acid sequence which is identical to or bear more than 90% sequence homology to the CD3 binding domain of a T-cell activating bispecific/multispecific antibody. In an exemplary embodiment, the IMA is a centyrin that binds to the same and/or competing epitope of CD3 antigen as bound by a T-cell activating bispecific/multispecific antibody.

In an exemplary embodiment, the IMA is a vHH domain that has amino acid sequence which is identical to or bear more than 90% sequence homology to the CD3 antigen binding domain of a T-cell activating bispecific/multispecific antibody. In an exemplary embodiment, the IMA is a vHH domain that binds to the same and/or competing epitope of CD3 antigen as bound by the CD3-binding domain of a T-cell activating bispecific/multispecific antibody.

In an exemplary embodiment, the IMA is a non-immunoglobulin antigen binding scaffold that has amino acid sequence which is identical to or bear more than 90% sequence homology to the CD3 antigen binding domain of the CAR or the T-cell activating bispecific/multispecific antibody. In an exemplary embodiment, the IMA is a non-immunoglobulin antigen binding scaffold that binds to the same and/or competing epitope of CD3 antigen as bound by the CD3 antigen binding domain of the CAR or the T-cell activating bispecific/multispecific antibody.

In an exemplary embodiment, the IMA is a scFv fragment having the vL and vH fragments that have amino acid sequences which are identical to or bear more than 90% sequence homology to the vL and vH fragment of the NKP46 binding domain of a NK-cell activating bispecific/multispecific antibody. In an exemplary embodiment, the IMA is a scFv fragment having the CDRs (complement determining regions) of the vL and vH fragments that have amino acid sequences which are identical to or bear more than 90% sequence homology to the CDRs vL and vH fragment of the antigen binding domain of a NK-cell activating bispecific/multispecific antibody. In an exemplary embodiment, the IMA is a scFv fragment that binds to the same or overlapping epitope of NKP46 as bound by the NK-cell activating bispecific/multispecific antibody.

In an exemplary embodiment, the IMA is an antibody fragment (e.g. a Fv, a Fab, a (Fab')2) having the vL and vH fragments that have amino acid sequences which are identical to or bear more than 90% sequence homology to the vL and vH fragment of the NKP46 binding domain of a NK-cell activating bispecific/multispecific antibody. In an exemplary embodiment, the IMA is an antibody fragment (e.g. a Fv, a Fab, a (Fab')2) having the CDRs (complement determining regions) of the vL and vH fragments that have amino acid sequences which are identical to or bear more than 90% sequence homology to the CDRs vL and vH fragment of the NKP46 binding domain of a NK-cell activating bispecific/multispecific antibody. In an exemplary embodiment, the IMA is an antibody fragment (e.g. a Fv, a Fab, a (Fab')2) that binds to the same or overlapping epitope of NKP46 as bound by a NK-cell activating bispecific/multispecific antibody.

In an exemplary embodiment, the IMA is a centyrin that has amino acid sequence which is identical to or bear more than 90% sequence homology to the NKP46 binding domain of a NK-cell activating bispecific/multispecific antibody. In an exemplary embodiment, the IMA is a centyrin that binds to the same and/or competing epitope of NKP46 antigen as bound by a NK-cell activating bispecific/multispecific antibody.

In an exemplary embodiment, the IMA is a vHH domain that has amino acid sequence which is identical to or bear more than 90% sequence homology to the NKp46 antigen binding domain of a NK-cell activating bispecific/multispecific antibody. In an exemplary embodiment, the IMA is a vHH domain that binds to the same and/or competing epitope of NKp46 antigen as bound by the NKp46-binding domain of a NK-cell activating bispecific/multispecific antibody.

In an exemplary embodiment, the IMA is a non-immunoglobulin antigen binding scaffold that has amino acid sequence which is identical to or bear more than 90% sequence homology to the NKP46 antigen binding domain of the CAR or the NK-cell activating bispecific/multispecific antibody. In an exemplary embodiment, the IMA is a non-immunoglobulin antigen binding scaffold that binds to the same and/or competing epitope of NKP46 antigen as bound by the NKP46 antigen binding domain of the CAR or the NK-cell activating bispecific/multispecific antibody.

The disclosure also provides a method of screening and isolating the appropriate IMA that can compete with an immune activating antibody for binding to a target antigen. In one embodiment, the method comprises 1) determining the affinity of the immune activating antibody (e.g., bispecific antibody) for a target antigen; 2) determining the epitope of the target antigen that is targeted by the immune activating antibody (e.g., bispecific antibody); 3) determining the epitope of the target antigen bound by a panel of candidate IMAs; 4) determining the affinity of the candidate IMAs for the target antigen; 5) selecting the IMAs that binds to the target antigen on the same epitope or overlapping epitope as bound by the immune activating antibody (e.g., T cell activating bispecific antibody) and have affinity for the target antigen that is at least equal or greater than the affinity of the immune activating antibody (e.g., bispecific antibody). It is to be noted that the above steps need not be performed in the order outlined above as long as they result in the selection of an IMA that has affinity for the target antigen that is at least equal or greater than the affinity of the immune activating antibody (e.g., T cell activating bispecific antibody). Methods to measure the affinity of antibodies and antibody fragments are known in the art, including but not limited to surface plasma resonance measurement using Biacore and a highly sensitive and specific luciferase based reporter assay for antigen detection as described in PCT/US2017/025602. Methods to measure the epitope targeted by an antibody, an antibody fragment or a non-immunoglobulin antigen binding domain are known in the art.

The disclosure also provides a method of screening and isolating the appropriate IMA that can compete with a CAR or a next generation CAR for binding to a target antigen. In an exemplary embodiment, the method comprises of 1) determining the affinity of the CAR or the antigen binding domain of the CAR for a target antigen; 2) determining the epitope of the target antigen that is targeted by CAR; 3) determining the epitope of the target antigen bound by a panel of candidate IMAs; 4) determining the affinity of the candidate IMAs for the target antigen; 5) selecting the IMAs that binds to the target antigen on the same epitope or overlapping epitope as bound by the CAR or the antigen binding domain (e.g., scFv) of a CAR and have affinity for the target antigen that is at least equal or greater than the affinity of CAR or the antigen binding domain (e.g., scFv) of the CAR. It is to be noted that the above steps need not be performed in the order outlined above as long as they result in the selection of an IMA that has affinity for the target antigen that is at least equal or greater than the affinity of CAR or the antigen binding domain (e.g., scFv) of the CAR. Methods to measure the affinity of antibodies and antibody fragments are known in the art, including but not limited to surface plasma resonance measurement using Biacore and a highly sensitive and specific luciferase based reporter assay for antigen detection as described in PCT/US2017/025602. Methods to measure the epitope targeted by an antibody, an antibody fragment or a non-immunoglobulin antigen binding domain are known in the art.

The disclosure also provides a method of screening and isolating the appropriate IMA that can compete with an immune activating antibody (e.g., T cell bispecific antibody or BiTE) for binding to an antigen expressed on immune cells (e.g., CD3 or NKp46). In one embodiment, the method comprises of 1) determining the affinity of the immune activating antibody (e.g., bispecific antibody) for a target antigen expressed on immune cells (e.g., CD3 or NKp46); 2) determining the epitope of the target antigen (e.g., CD3 or NKp46) that is targeted by the immune activating antibody (e.g., bispecific antibody); 3) determining the epitope of the target antigen (e.g., CD3 or NKp46) bound by a panel of candidate IMAs; 4) determining the affinity of the candidate IMAs for the target antigen (e.g., CD3 or NKp46); 5) selecting the IMAs that binds to the target antigen (e.g., CD3 or NKp46) on the same epitope or overlapping epitope as bound by the immune activating antibody (e.g., T cell bispecific antibody or NKp46 bispecific antibody) and have affinity for the target antigen that is at least equal or greater than the affinity of the immune activating antibody (e.g., T cell bispecific antibody or NKp46 bispecific antibody); 6) selecting the IMA that does not induce activation of proliferation of the immune cells (e.g., T cell or NK cells). It is to be noted that the above steps need not be performed in the order outlined above.

In an embodiment, the IMA binds to one or more of the antigens selected from but not limited to: CD3, NKp46, CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bDGa1p(l-4)bDG1cp(1-1) Cer); TNF receptor family member B cell maturation (BCMA); Tn antigen ((Tn Ag) or (Ga1NAcα-Ser/Thr)); prostate-specific membrane antigen (PSMA); Receptor tyrosine kinase-like orphan receptor 1 (ROR1); FmsLike Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDCla1p(1-4)bDG1cp(1-1)Cer); transglutaminase 5 (TGS5); high molecular weight-melanomaassociated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPIB 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCR-gamma-delta, NKG2D, CD32 (FCGR2A), CSPG4-HMW- MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel and Integrin B7.

In an exemplary embodiment, the activity of CD19 CAR-T cells or CD19×CD3 or a CD19×NKp46 bispecific antibody is controlled by administration to the subject receiving the CD19 CAR-T cells or CD19×CD3 bispecific antibody or a CD19×NKp46 antibody an IMA that competes with the CD19 CAR-T cells or CD19×CD3 bispecific antibody or CD19×NKp46 bispecific for binding to the CD19 antigen expressed on the target cells. In an exemplary embodiment, the activity of CD19 CAR-T cells or CD19×CD3 bispecific antibody a CD19×NKp46 antibody is controlled by administration to the subject receiving the CD19 CAR-T cells or CD19×CD3 bispecific or a CD19×NKp46 antibody an IMA that binds to the same or the overlapping epitope of CD19 as the CD19 CAR-T cells or CD19×CD3 antibody or a CD19×NKp46 antibody bispecific antibody.

In an embodiment, the IMA is (1) a CD19 antibody; (2) a CD19 antibody fragment (e.g. a Fv, a Fab, a (Fab')2); (3) a heavy chain variable region of a CD19 antibody (vH domain) or a fragment thereof; (4) a light chain variable region of a CD19 antibody (vL domain) or a fragment thereof; (5) a CD19 single chain variable fragment (scFv) or a fragment thereof; (6) a single domain CD19 antibody (SDAB) or a fragment thereof; (7) a camelid CD19 VHH domain or a fragment thereof; (8) a monomeric variable region of a CD19 antibody; (9) a non-immunoglobulin CD19 antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; and/or (10) any other CD19-binding molecule. In an embodiment, the IMA is a soluble CD19 receptor, e.g., CD19-Fc.

In an embodiment, the IMA is (1) a CD3 (e.g., CD3e) antagonist antibody; (2) a CD3 (e.g., CD3e) antibody fragment (e.g. a Fv, a Fab, a (Fab')2); (3) a heavy chain variable region of a CD3 antibody (vH domain) or a fragment thereof; (4) a light chain variable region of a CD3 antibody (vL domain) or a fragment thereof; (5) a CD3 (e.g., CD3e) single chain variable fragment (scFv) or a fragment thereof; (6) a single domain CD3 (e.g., CD3e) antibody (SDAB) or a fragment thereof; (7) a camelid CD3 (e.g., CD3e) VHH domain or a fragment thereof; (8) a monomeric variable region of a CD3 (e.g., CD3e) antibody; (9) a non-immunoglobulin CD3 (e.g., CD3e) antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; and/or (10) any other CD3 (e.g., CD3e)-binding molecule that has an antagonistic activity. In an embodiment, the IMA is a soluble CD3 receptor, e.g., CD3e-Fc.

In an embodiment, the IMA is (1) a NK (e.g., NKp46) antagonist antibody; (2) a NK (e.g., NKp46) antibody fragment (e.g. a Fv, a Fab, a (Fab')2); (3) a heavy chain variable region of a NK (e.g., NKp46) antibody (vH domain) or a fragment thereof; (4) a light chain variable region of a NK (e.g., NKp46) antibody (vL domain) or a fragment thereof; (5) a NK (e.g., NKp46) single chain variable fragment (scFv) or a fragment thereof; (6) a single domain NK (e.g., NKp46) antibody (SDAB) or a fragment thereof; (7) a camelid NK (e.g., NKp46) VHH domain or a fragment thereof; (8) a monomeric variable region of a NK (e.g., NKp46) antibody; (9) a non-immunoglobulin NK (e.g., NKp46) antigen binding scaffold such as a DARPIN, an affibody, an affilin, an adnectin, an affitin, an obodies, a repebody, a fynomer, an alphabody, an avimer, an atrimer, a centyrin, a pronectin, an anticalin, a kunitz domain, an Armadillo repeat protein or a fragment thereof; and/or (10) any other NK (e.g., NKp46)-binding molecule that has an antagonistic activity. In an embodiment, the IMA is a soluble NK receptor, e.g., NKp46-Fc.

A problem with the use of any IMA in the above applications is the long half-life that may interfere with the recovery of function of the immune activating receptor (e.g., CAR) and T/NK cell activating bispecific/multispecific antibodies. Therefore, in one embodiment, the IMA has a short serum half-life. In an embodiment, the serum half-life of the IMA is shorter than the serum half-life of the cell therapy or the T/NK cell activating bispecific/multispecific antibody. In one embodiment, the IMA has a serum half-life of less than 1 hour, 2 hour, 3 hour, 4 hour, 5 hour, 6 hours, 7 hour, 8 hour, 10 hour, 12 hour or 24 hours. In an exemplary embodiment, the agent has a serum clearance of more than 0.5 L/h, 1 L/h, 2 L/h, or 5 L/h. In an embodiment, the agent is less than 20 kD, 25 kD, 50 kD, 100 kD, 200 kD or 500 kD in size. In an embodiment, the IMA is administered to a subject before, during or after the administration of the immune effector cell therapy or immune activating bispecific antibody. In an embodiment, the IMA is administered to a subject receiving an immune effector cell therapy or immune activating bispecific antibody by parental administration, e.g., by intravenous, intramuscular, intraperitoneal, intra-thecal, intraventricular, intrapleural, intratumoral or subcutaneous routes.

The term "effective dose" or "effective dosage" is defined as an amount sufficient to achieve or at least partially achieve the desired effect. The term "therapeutically effective dose" is defined as an amount sufficient to prevent or cure or at least partially prevent or arrest the side effects and complications of an immune therapy in a patient already suffering from the disease. The dose of the IMA that is to be used in accordance with the embodiments of the disclosure is not limited, i.e., it will depend on the circumstances of the individual patient. Amounts or doses effective for this use will depend on the condition to be treated (the indication), the delivered therapeutic modality (e.g., cell therapy or the immune cell activating bispecific/multispecific antibody), the relative affinity of the antigen (e.g., CD19, CD20, CD22, CD3, NKp46 etc.) binding domain of the immune cell or the immune cell activating antibody as compared to the affinity of the IMA to the same antigen, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 μg/kg to up to about 30 mg/kg or more, depending on the factors mentioned above. In specific embodiments, the dosage may range from 1.0 μg/kg up to about 20 mg/kg, optionally from 10 μg/kg up to about 10 mg/kg or from 100 μg/kg up to about 5 mg/kg.

In an embodiment, the IMA is administered to a subject receiving an immune effector cell therapy or an immune cell (e.g., T cell or NK cell) activating bispecific/multispecific antibody by continuous infusion at a rate of more than 0.5, 1.5, 3, 5, 10, 15, 30, 60, 90, 100, 200, 500, 1000 μg/m$^2$/d. In an embodiment, the rate of infusion of the IMA is adjusted so as to mitigate the toxicity of the immune effector cell therapy or immune cell activating bispecific/multispecific antibody therapy. In an exemplary embodiment, the rate of infusion of the IMA is adjusted based on the vital signs and parameters (e.g., temperature, systolic blood pressure, diastolic blood pressure, heart rate, respiratory rate, oxygen saturation in blood, urine output etc.) of the subject. In an exemplary embodiment, the rate of the infusion of the IMA is adjusted to maintain a systolic blood pressure above 90 mm Hg and a diastolic blood pressure above 60 mm Hg. In an exemplary embodiment, the rate of the infusion of the IMA is adjusted to maintain a heart rate less than 120 or 130 or 150 beats per minute. In an exemplary embodiment, the rate of the infusion of the IMA is adjusted to maintain oxygen saturation as measured by pulse oximetry above 90%. In an exemplary embodiment, the rate of infusion of the IMA is adjusted to prevent signs and symptoms of cytokine release syndrome (e.g., fall in blood pressure, fall in urine output or fall in oxygen saturation) and/or neurotoxicity (e.g., headache, confusion, altered mental status, tremors, seizure, aphasia etc). In an exemplary embodiment, the rate of infusion of the IMA is adjusted based on laboratory parameters of cytokine release syndrome (e.g., level of serum C reactive protein, serum IL6, serum ferritin, serum creatinine etc.). In an embodiment, the IMA is delivered by an intravenous bolus injection. In an embodiment, the IMA is delivered by an intravenous bolus injection followed by continuous infusion. In an embodiment, the IMA is administered to maintain its steady state plasma concentration above 25 pg/mL, 50 pg/ml, 100 pg/ml, 250 pg/ml, 500 pg/ml, 1000 pg/ml, 2500 pg/ml or 5000 pg/ml. In an embodiment, the IMA is administered for more than 10 min, 30 min, 1 hour, 2 hours, 4 hours, 8 hours, 12 hours, 24 hours, 2 days, 5 days, 7 days, 14 days, 21 days, or 30 days.

In an exemplary embodiment, the subject receives immune effector cells (e.g., CAR-T cells) expressing a CAR (including a next generation CAR, such as SIR/Ab-TCR/TFP/TRI-TAC) (e.g., SEQ ID NO: 1455-1461, 3461-3463, 4193-4196, 4437-4440 etc.) targeting CD19 or a T/NK cell activating bispecific (e.g., Blinatumomab) or multispecifc antibody targeting CD19 and the IMA is a corresponding CD19 scFv represented by exemplary SEQ ID NO: 6091-6097.

In an exemplary embodiment, the subject receives immune effector cells (e.g., CAR-T cells) expressing a CAR/SIR/Ab-TCR/TFP/TRI-TAC (e.g., SEQ ID NO: 1479-1491, 4210-4212, 4454-4456) targeting CD20 or receives a T/NK cell activating bispecific or multispecifc antibody targeting CD20 and the IMA is a corresponding CD20 scFv represented by SEQ ID NO: 6115-6127.

In an exemplary embodiment, the subject receives immune effector cells expressing a CAR/SIR/Ab-TCR/TFP/TRI-TAC targeting CD22 (e.g., SEQ ID NO: 1491, 3480) or receives a T/NK cell activating bispecific or multispecifc antibody targeting CD22 and the IMA is a corresponding CD22 scFv represented by SEQ ID NO: 6127.

In an exemplary embodiment, the subject receives immune effector cells expressing a CAR/SIR/Ab-TCR/TFP/TRI-TAC targeting BCMA (e.g., SEQ ID NO: 1469-1475) or receives a T/NK cell activating bispecific or multispecifc antibody targeting BCMA and the IMA is a corresponding BCMA scFv represented by SEQ ID NO: 6105-6111.

In an exemplary embodiment, the subject receives immune effector cells expressing a CAR/SIR/Ab-TCR/TFP/TRI-TAC targeting CD123 (e.g., SEQ ID NO: 1512-1524, 4828-4838) or receives a T/NK cell activating bispecific or multispecifc antibody targeting CD123 and the IMA is a corresponding CD123 scFv represented by SEQ ID NO: 6148-6160.

In an exemplary embodiment, the subject receives immune effector cells expressing a CAR/SIR/Ab-TCR/TFP/TRI-TAC targeting FLT3 (e.g., SEQ ID NO: 1666-1669, 3686-3687, 4906-4907) or receives a T/NK cell activating bispecific or multispecifc antibody targeting FLT3 and the IMA is a corresponding FLT3 scFv represented by SEQ ID NO: 6302-6305.

In an exemplary embodiment, the subject receives immune effector cells (e.g., CAR-T cells) targeting MPL (e.g., SEQ ID NO: 1595-1598, 3793-3795) or a T/NK cell activating bispecific or multispecifc antibody targeting MPL and the IMA is a MPL scFv represented by SEQ ID NO: 6231-6234.

In an exemplary embodiment, the subject receives immune effector cells (e.g., CAR-T cells) targeting CD33 (e.g., SEQ ID NO:1498-1499, 3730-3731) or a T/NK cell activating bispecific or multispecifc antibody targeting CD33 and the IMA is a CD33 scFv represented by SEQ ID NO: 6134-6135.

In an exemplary embodiment, the subject receives immune effector cells (e.g., CAR-T cells) targeting Mesothelin (e.g., SEQ ID NO:1684-1687, 3698-3699) or a T/NK cell activating bispecific or multispecifc antibody targeting Mesothelin and the IMA is a Mesothelin scFv represented by SEQ ID NO: 6320-6323.

In an exemplary embodiment, the subject receives immune effector cells (e.g., CAR-T cells) targeting IL13Ra2 (e.g., SEQ ID NO:1584-1585, 3539-3540) or a T/NK cell activating bispecific or multispecifc antibody targeting IL13Ra2 and the IMA is a IL13Ra2 scFv represented by SEQ ID NO: 6221-6222.

The SEQ ID NOs of exemplary CARs are presented in Table 8. The SEQ ID NO of additional CARs, including next generation CARs (e.g., SIR, Ab-TCR, TFP etc.) are presented in Tables 13 and 14. The SEQ ID NO of additional CARs, including next generation CARs (e.g., SIR, Ab-TCR, TFP etc.) and T/NK cell activating Bispecific antibodies are given in patent applications PCT/US2017/024843, PCT/US2017/064379, and PCT/US18/53247 which are incorporated herein in their entirely by reference. The SEQ ID NO of exemplary scFv that can serve as IMA for modulating the activity and toxicity of the CARs and T cell activating Bispecific antibodies are presented in Table 7. Additional IMA (e.g., Fab or (Fab')2 fragments) comprising the antigen binding domains (e.g., vL and vH) of the scFv can be generated by those skilled in the art.

In one embodiment, the subject can be administered an IMA which prevents, reduces or ameliorates a side effect associated with the administration of an immune effector cell (e.g., CAR-T) or T/NK cell activating antibody (e.g., Blinatumomab). Side effects associated with the administration of an immune effector cell (e.g., CAR-T) or T cell activating antibody include, but are not limited to CRS, and hemophagocytic lymphohistiocytosis (HLH), also termed Macrophage Activation Syndrome (MAS). Symptoms of CRS include high fevers, nausea, transient hypotension, hypoxia, and the like. CRS may include clinical constitutional signs and symptoms such as fever, fatigue, anorexia, myalgias, arthalgias, nausea, vomiting, and headache. CRS may include clinical skin signs and symptoms such as rash. CRS may include clinical gastrointestinal signs and symptoms such as nausea, vomiting and diarrhea. CRS may include clinical respiratory signs and symptoms such as tachypnea and hypoxemia. CRS may include clinical cardiovascular signs and symptoms such as tachycardia, widened pulse pressure, hypotension, increased cardiac output (early) and potentially diminished cardiac output (late). CRS may include clinical coagulation signs and symptoms such as elevated d-dimer, hypofibrinogenemia with or without bleeding. CRS may include clinical renal signs and symptoms such as azotemia. CRS may include clinical hepatic signs and symptoms such as transaminitis and hyperbilirubinemia. Administration of immune effector cells (e.g., CAR-T) and T cell activating antibodies (e.g., Blinatumomab) are also associated with neurological complications, referred to as CRES (CAR-related encephalopathay syndrome). CRES may include clinical neurologic signs and symptoms such as headache, mental status changes, confusion, delirium, word finding difficulty or frank aphasia, hallucinations, tremor, altered gait, and seizures.

Accordingly, the methods described herein can comprise administering an immune effector cell (e.g., CAR-T) or T/NK cell activating antibody (e.g., Blinatumomab) described herein to a subject and further administering one or more IMAs to manage elevated levels of a soluble factor resulting from treatment with immune effector cell (e.g., CAR-T) or T/NK cell activating antibody (e.g., Blinatumomab). In one embodiment, the soluble factor elevated in the subject is one or more of IFN-y, TNFa, IL-2 and IL-6. In an embodiment, the factor elevated in the subject is one or more of IL-1, GM-CSF, IL-10, IL-8, IL-5 and fraktalkine. Therefore, an IMA administered to treat this side effect can be an agent that reduced the production of one or more of these soluble factors. In one embodiment, an IMA is administered along with an agent that neutralizes one or more of soluble factors. In one embodiment, the agent that neutralizes one or more of these soluble forms is an antibody or antigen binding fragment thereof. Examples of such agents include, but are not limited to a steroid (e.g., corticosteroid), an inhibitor of TNFa, and an inhibitor of IL-6. An example of a TNFa inhibitor is an anti-TNFa antibody molecule such as, infliximab, adalimumab, certolizumab pegol, and golimumab. Another example of a TNFa inhibitor is a fusion protein such as entanercept. Small molecule inhibitors of TNFa include, but are not limited to, xanthine derivatives (e.g. pentoxifylline) and bupropion. An example of an IL-6 inhibitor is an anti-IL-6 antibody molecule or an anti-IL-6 receptor antibody molecule such as tocilizumab (toe), sarilumab, elsilimomab, CNTO 328, ALD518/BMS-945429, CNTO 136, CPSI-2364, CDP6038, VX30, ARGX-109, FE301, and FM101. In one embodiment, the anti-IL-6 receptor antibody molecule is tocilizumab. An example of an IL-1R based inhibitor is anakinra.

In an embodiment, the subject is administered an IMA to manage (i.e., prevent or ameliorate) elevated levels of a soluble factor (e.g., cytokines) resulting from treatment with an immune effector cell, e.g., CAR-expressing cell. In an embodiment, the subject is administered an IMA to manage (i.e., prevent or ameliorate) elevated levels of a soluble factor (e.g., cytokines) resulting from treatment with a bispecific antibody (e.g., Blinatumomab or BCMA×CD3 bispecific antibody) that binds to immune effector cell. In an embodiment, the subject is administered an IMA to manage side effects (e.g. CRS and neurotoxicity) resulting from treatment with an immune effector cell (e.g., CAR-T cells or TCR-T cells or TILs) or a bispecific antibody (e.g., Blinatumomab) that binds to immune effector cell. In an embodiment, the subject is administered an IMA to manage elevated levels of a soluble factor (e.g., cytokines) resulting from treatment with a bispecific antibody that binds to immune effector cell. In an embodiment, the subject is administered an IMA to manage elevated levels of a soluble factor resulting from treatment with a TCR-expressing cell. In an embodiment, the subject is administered an IMA to manage elevated levels of a soluble factor (e.g., cytokines) resulting from treatment with any immune effector cell. In an embodiment, an IMA (e.g., SEQ ID NO: 6591-6839) is administered to a subject for the prevention or treatment of cytokine release syndrome and other toxicities, including neurotoxicity, resulting from administration of immune effector cell therapy (e.g., CAR-T, TCR-T, TILs, Blinatumomab, BCMA×CD3 BiTE etc.) at a dose of about 50 $\mu g/m^2/d$ (e.g., 55, 75, 100, 200, 500 1000 $\mu g/m^2/d$) by continuous intravenous infusion.

In some embodiments, IMA is administered by intrathecal or intra-ventricular injection to prevent or treat neurotoxicity associated with administration of cell therapy products. In some embodiment, the dose of IMA for intrathecal or intra-ventricular injection is about 1 mg (e.g., 1 mg, 2 mg, 5 mg, 10 mg, 20 mg) every 2-5 days. In an embodiment, more than one course of IMA is administered in case of no response to first dose. In an embodiment, IMA is administered prophylactically, i.e., to prevent the development of CRS. In other embodiment, an IMA is administered to treat CRS.

In yet other embodiment, an IMA is administered at the earliest signs and symptoms of CRS and/or neurotoxicity/CRES, such as fever >38.5° C., drop in systolic or diastolic blood pressure of more than 10 mm Hg, systolic blood pressure of <100 mm Hg or diastolic blood pressure of <70 mm Hg. In an embodiment, an IMA is administered as a monotherapy. In other embodiments, an IMA is administered in combination with other agents, e.g., corticosteroids, tocilizumab or anakinra.

Provided in some aspects are methods of treatment including administering to a subject an IMA capable of treating, preventing, delaying, or attenuating the development of a toxicity. In some cases, the IMA is administered prior to administration of immunotherapy and/or a cell therapy. In some cases, the IMA is administered concurrent with administration of immunotherapy and/or a cell therapy. In some cases, the IMA is administered after administration of immunotherapy and/or a cell therapy. In some cases, the IMA is administered before, concurrent with and after administration of immunotherapy and/or a cell therapy. In some embodiments, the initiation of administration of the IMA or other treatment is at a time that is less than or no more than six, five, four or three, one days before initiation of the administration of the cell or immune therapy. In some embodiments, the initiation of administration of the IMA or other treatment is at a time at which the subject does not exhibit a sign or symptom of severe cytokine release syndrome (CRS) and/or does not exhibit grade 2 or higher CRS. In some embodiments, the initiation of administration of the IMA or other treatment is at a time at which the subject does not exhibit a sign or symptom of severe neurotoxicity and/or does not exhibit grade 2 or higher neurotoxicity. In some aspects, between the time of the initiation of the administration of the therapy and the time of the initiation of administration of the IMA or other treatment the subject has not exhibited severe CRS and/or has not exhibited grade 2 or higher CRS. In some instances, between the time of the initiation of the administration of the cell or immune therapy and the time of the initiation of administration of the IMA or other treatment, the subject has not exhibited severe neurotoxicity and/or does not exhibit grade 2 or higher neurotoxicity.

In some of any such embodiments, the administration of IMA or other treatment is initiated at a time at which the subject exhibits grade 1 CRS or is administered within 24 hours after the subject exhibits a first sign or symptom of grade 1 CRS. In some cases, the administration of IMA or other treatment is initiated at a time at which the subject exhibits a sign or symptom of CRS and/or exhibits grade 1 CRS. In some cases, the administration of IMA or other treatment is initiated within 24 hours after the subject exhibits a first sign or symptom of grade 1 CRS following the initiation of administration of the therapy.

In some embodiments, a sign or symptom of grade 1 CRS is a fever. In some cases, the administration of IMA or other treatment is initiated within 24 hours after the first sign of a fever following initiation of administration of the therapy.

Provided in some aspects are methods of treatment including administering to a subject previously administered a therapy, such as an immunotherapy and/or a cell therapy, an IMA or other treatment capable of treating, preventing, delaying, or attenuating the development of a toxicity. In some cases, the IMA or other treatment is administered within 24 hours of the first sign of a fever following initiation of administration of the therapy.

In some embodiments, prior to administering the IMA or other treatment, the method includes administering to the subject the therapy for treating a disease or condition.

Provided in some embodiments are methods of treatment including administering to a subject having a disease or condition an immunotherapy and/or a cell therapy. In some instances, the method includes administering to the subject an IMA or other treatment capable of treating, preventing, delaying, or attenuating the development of a toxicity to the administered immunotherapy and/or cell therapy at a time within 24 hours after the first sign of a fever following initiation of administration of the therapy. In some aspects, the IMA or other treatment is administered within about 16 hours, within about 12 hours, within about 8 hours, within about 2 hours or within about 1 hour after the first sign of a fever following initiation of administration of the therapy.

In some embodiments, the fever is a sustained fever. In some cases, the fever is not reduced or not reduced by more than 1° C. after treatment with an antipyretic. In some aspects, the fever is a fever that is not reduced or not reduced by more than 1° C. after treatment with an antipyretic. In some instances, the fever has not been reduced by more than 1° C., following treatment of the subject with an antipyretic.

In some embodiments, the fever includes a temperature of at least or at least about 38.0° C. In some aspects, the fever includes a temperature that is between or between about 38.0° C. and 42.0° C., 38.0° C. and 39.0° C., 39.0° C. and 40.0° C. or 40.0° C. and 42.0° C., each inclusive. In some embodiments, the fever includes a temperature that is greater than or greater than about or is or is about 38.5° C., 39.0° C., 39.5° C., 40.0° C., 41.0° C., 42.0° C.

In some embodiments, the IMA or other treatment is administered less than ten days after initiation of administration of the therapy, less than five days after initiation of administration of the therapy, less than four days after initiation of administration of the therapy or less than three days after initiation of administration of the therapy.

In some embodiments, the therapy is or comprises a cell therapy. In some cases, the cell therapy is or comprises an adoptive cell therapy. In some aspects, the therapy is or comprises a tumor infiltrating lymphocytic (TIL) therapy, a transgenic TCR therapy or a recombinant receptor-expressing cell therapy, which optionally is a T cell therapy. In some embodiments, the therapy is a chimeric antigen receptor (CAR)-expressing T cell therapy. In some embodiments, the therapy is a bispecific/multispecific T cell engager therapy. In an exemplary embodiment, the therapy is Blinatumomab. In some embodiments, the therapy is a CD123×CD3 Bispecific antibody. In some embodiment, the therapy is a CD33×CD3 bispecific antibody therapy. In some embodiment, the therapy is a CD123×CD3 DART or a CD19×CD3 DART.

In some cases, the IMA is administered in combination with other treatment including a steroid, or an antagonist or inhibitor of a cytokine receptor or cytokine selected from among IL-10, IL-10R, IL-6, IL-6 receptor, IFNγ, IFNGR, IL-2, IL-2R/CD25, MCP-1, CCR2, CCR4, CCR5, TNFalpha, TNFR1, IL-1, and IL-1Ralpha/IL-1beta.

In some aspects an IMA is administered in combination with an agent selected from among an antibody or antigen-binding fragment, a small molecule, a protein or peptide and a nucleic acid. In some cases, the agent or other treatment is or comprises an agent selected from among tocilizumab, anakinra, situximab, sarilumab, olokizumab (CDP6038), elsilimomab, ALD518/BMS-945429, sirukumab (CNTO 136), CPSI-2634, ARGX-109, FE301 and FM101.

In some embodiments, the IMA is administered in combination with tocilizumab. In some such embodiments, the tocilizumab is administered in a dosage amount from about 1 mg/kg to 10 mg/kg, 2 mg/kg to 8 mg/kg, 2 mg/kg to 6 mg/kg, 2 mg/kg to 4 mg/kg or 6 mg/kg to 8 mg/kg, each inclusive, or the tocilizumab is administered in a dosage amount of at least or at least about or about 2 mg/kg, 4 mg/kg, 6 mg/kg or 8 mg/kg.

In some embodiments, the IMA is administered in combination with anakinra. In some such embodiments, the anakinra is administered in a dosage amount of about 1 mg/kg to 10 mg/kg, 2 mg/kg to 8 mg/kg, 2 mg/kg to 6 mg/kg, 2 mg/kg to 4 mg/kg or 6 mg/kg to 8 mg/kg, each inclusive, or the anakinra is administered in a dosage amount of at least or at least about or about 2 mg/kg, 4 mg/kg, 6 mg/kg or 8 mg/kg.

In some aspects, the method further includes administering a steroid to the subject in combination with an IMA. In some such aspects, the steroid is administered at a time that is within 7 days, 8 days or 9 days after administration of the therapy. In some cases, the steroid is administered at a time that is within 24 hours after the first sign of hypotension following administration of the therapy. In some instances, the steroid is administered at a time in which the subject exhibits grade 2 cytokine release syndrome (CRS) or within 24 hours after the subject exhibits a first sign of grade 2 CRS following administration of the therapy. In some embodiments, the steroid is administered at a time in which the subject exhibits grade 2 neurotoxicity or within 24 hours after the subject exhibits a first sign or symptom of grade 2 neurotoxicity following administration of the therapy.

In some embodiments, the other agent that is administered in combination with an IMA is or comprises a steroid that is or comprises a corticosteroid. In some aspects, the agent is a steroid that is or comprises a glucocorticoid. In some cases, the corticosteroid is or comprises dexamethasone or prednisone. In some cases, the steroid is administered intravenously or orally.

In some instances, the steroid is administered in an equivalent dosage amount of from or from about 1.0 mg to 20 mg dexamethasone per day, 1.0 mg to 10 mg dexamethasone per day, or 2.0 mg to 6.0 mg dexamethasone per day, each inclusive.

In some embodiments, at the time of administration of the IMA, the subject does not exhibit severe CRS, does not exhibit grade 3 or higher CRS, or does not exhibit severe neurotoxicity or does not exhibit grade 3 or higher neurotoxicity.

In some aspects, the administration of IMA is initiated prior to or within 24 hours after or contemporaneously with the first sign of hypotension following initiation of administration of the therapy. In some cases, the IMA is administered simultaneously with initiation of a pressor therapy. In some instances, hypotension includes systolic blood pressure less than or about less than 90 mm Hg, 80 mm Hg, or 70 mm Hg. In some instances, hypotension includes diastolic blood pressure less than 60 mm Hg, 50 mm Hg or 40 mm Hg.

In some embodiments, prior to administering the IMA, the method includes administering a treatment capable of treating, preventing, delaying, or attenuating the development of a toxicity. In some aspects, the IMA and/or other treatment is administered at a time that is less than or no more than ten, seven, six, five, four or three days after initiation of the administration of the therapy. In some aspects, the IMA and/or other treatment is administered at a time at which the subject does not exhibit a sign or symptom of severe cytokine release syndrome (CRS) and/or does not exhibit grade 2 or higher CRS. In some aspects, between the time of the initiation of the administration of the therapy and the time of the administration of the IMA or other treatment, the subject has not exhibited severe CRS and/or does not exhibit grade 2 or higher CRS. In some aspects, the IMA or other treatment is administered at a time at which the subject does not exhibit a sign or symptom of severe neurotoxicity and/or does not exhibit grade 2 or higher neurotoxicity. In some embodiments, between the time of the initiation of the administration of the therapy and the time of the administration of the agent or other treatment, the subject has not exhibited severe neurotoxicity and/or does not exhibit grade 2 or higher neurotoxicity.

In some embodiments, the therapy includes a dose of cells expressing a recombinant receptor.

In some aspects, the IMA or other treatment is administered at a time at which the subject exhibits grade 1 CRS or is administered within 24 hours after the subject exhibits a first sign or symptom of grade 1 CRS. In some embodiments, a sign or symptom of grade 1 CRS is a fever. In some embodiments, the first sign or symptom of CRS is a fever. In some instances, the agent or other treatment is administered within 24 hours after the first sign of a fever following the initiation of administration of the therapy.

In some aspects, prior to administering the IMA, the method includes administering an agent or other treatment capable of treating, preventing, delaying, or attenuating the development of a toxicity. In some cases, the agent or other treatment is administered within 24 hours after the first sign of a fever following the initiation of administration of the therapy. In some aspects, the agent or other treatment is administered within about 16 hours, within about 12 hours, within about 8 hours, within about 2 hours or within about 1 hour after the first sign of a fever following the initiation of administration of the therapy.

In some embodiments, the fever is a sustained fever. In some instances, the fever is not reduced or not reduced by more than 1° C. after treatment with an antipyretic. In some embodiments, the fever is a fever that is not reduced or not reduced by more than 1° C. after treatment with an antipyretic. In some cases, the fever has not been reduced by more than 1° C., following treatment of the subject with an antipyretic.

In some cases, the fever includes a temperature of at least or at least about 38.0° C. In some embodiments, the fever includes a temperature that is between or between about 38.0° C. and 42.0° C., 38.0° C. and 39.0° C., 39.0° C. and 40.0° C. or 40.0° C. and 42.0° C., each inclusive. In some aspects, the fever includes a temperature that is greater than or greater than about or is or is about 38.5° C., 39.0° C., 39.5° C., 40.0° C., 41.0° C., 42.0° C.

In some embodiments, the IMA or other treatment is administered less than five days after initiation of administration of the therapy, less than four days after initiation of administration of the therapy or less than three days after initiation of administration of the therapy.

In some cases of any of the above embodiments, the therapy is or comprises a cell therapy. In some embodiments, the cell therapy is or comprises an adoptive cell therapy. In some instances, the therapy is or comprises a tumor infiltrating lymphocytic (TIL) therapy, a transgenic TCR therapy or a recombinant-receptor expressing cell therapy, which optionally is a T cell therapy. In some embodiments, the therapy is or includes a chimeric antigen receptor (CAR)-expressing cell therapy.

In some embodiments, the therapy is or comprises a cell therapy and the cells are administered in a single pharmaceutical composition containing the cells. In some cases, the therapy is or comprises a cell therapy and the dose of cells is a split dose, wherein the cells of the dose are administered in a plurality of compositions, collectively containing the cells of the dose, over a period of no more than three days.

In some embodiments, the disease or condition for which an IMA is administered is or comprises a tumor or a cancer. In some cases, the disease or condition is or comprises a leukemia or lymphoma. In some embodiments, the disease or condition is a B cell malignancy or is a hematological disease or condition. In some aspects, the disease or condition is or comprises a non-Hodgkin lymphoma (NHL) or acute lymphoblastic leukemia (ALL).

In some embodiments, the therapy is a cell therapy including a dose of cells expressing a recombinant receptor. In some aspects, the recombinant receptor binds to, recognizes or targets an antigen associated with the disease or condition. In some cases, the recombinant receptor is a T cell receptor or a functional non-T cell receptor. In some instances, the recombinant receptor is a chimeric antigen receptor (CAR). In some instances, the recombinant receptor is a next generation CAR, such as a synthetic immune receptor (SIR), an Ab-TCR, a TFP and the like. In some embodiment, the recombinant receptor targets one or more of the antigens selected from but not limited to the following: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bDGa1p(1-4)bDG1cp(1-1) Cer); TNF receptor family member B cell maturation (BCMA); Tn antigen ((Tn Ag) or (Ga1NAcα-Ser/Thr)); prostate-specific membrane antigen (PSMA); Receptor tyrosine kinase-like orphan receptor 1 (ROR1); FmsLike Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EP-CAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDCla1p(1-4)bDG1cp(1-1)Cer); transglutaminase 5 (TGS5); high molecular weight-melanomaassociated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WTI); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPIB 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLU), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCR-gamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel and Integrin B7.

In some embodiments, the therapy is or comprises a therapy containing a dose of cells containing T cells. In some cases, the T cells are CD4+ or CD8+. In some embodiments, the T cells are autologous to the subject. In some embodiments, the T cells are allogeneic to the subject.

In some embodiments, the therapy is a T/NK cell activating antibody therapy. In some embodiments, the therapy is a T/NK cell activating bispecific or multispecific antibody therapy. In some aspects, the T/NK cell activating bispecific or multispecific antibody binds to, recognizes or targets an antigen associated with the disease or condition. In some aspects, the T/NK cell activating bispecific or multispecific antibody binds to, recognizes or targets one or more of the antigens selected from but not limited to the following: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33;

epidermal growth factor receptor variant III (EGFRviii); ganglioside G2 (GD2); ganglioside GD3 (aNeu5Ac(2-8) aNeu5Ac(2-3)bDGa1p(1-4)bDG1cp(1-1)Cer); TNF receptor family member B cell maturation (BCMA); Tn antigen ((Tn Ag) or (Ga1NAcα-Ser/Thr)); prostate-specific membrane antigen (PSMA); Receptor tyrosine kinase-like orphan receptor 1 (ROR1); FmsLike Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(1-4) bDG1cp(1-1)Cer); transglutaminase 5 (TGS5); high molecular weight-melanomaassociated antigen (HMW-MAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPlB 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLU), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCRgamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2)), P-glycoprotein, STEAP1, LIV1, NECTIN-4, CRIPTO, GPA33, BST1/CD157, low conductance chloride channel and Integrin B7.

Any of the methods of the disclosure described herein may be useful for treating cancer, such as hematologic cancer, including B cell proliferative disorders/malignancies. In particular, B cell proliferative disorders amenable to treatment with a cell therapy (CAR-T) or T/NK cell activating bispecific/multispecific antibody targeting an antigen (e.g., CD19, CD20, CD22, Lym1, Lym2, BCMA, CD138, CS1/SLAMF7 etc.) expressed on lymphoid cells in accordance with the methods described herein include, without limitation, non-Hodgkin's lymphoma (NHL), including diffuse large B cell lymphoma (DLBCL), which may be relapsed or refractory DLBCL, as well as other cancers including germinal-center B cell-like (GCB) diffuse large B cell lymphoma (DLBCL), activated B cell-like (ABC) DLBCL, follicular lymphoma (FL), mantle cell lymphoma (MCL), acute myeloid leukemia (AML), chronic lymphoid leukemia (CLL), marginal zone lymphoma (MZL), small lymphocytic leukemia (SLL), lymphoplasmacytic lymphoma (LL), Waldenstrom macroglobulinemia (WM), central nervous system lymphoma (CNSL), Burkitt's lymphoma (BL), B cell prolymphocytic leukemia, splenic marginal zone lymphoma, hairy cell leukemia, splenic lymphoma/leukemia, unclassifiable, splenic diffuse red pulp small B cell lymphoma, hairy cell leukemia variant, Waldenstrom macroglobulinemia, heavy chain diseases, a heavy chain disease, γ heavy chain disease, p heavy chain disease, plasma cell myeloma, solitary plasmacytoma of bone, extraosseous plasmacytoma, extranodal marginal zone lymphoma of mucosa-associated lymphoid tissue (MALT lymphoma), nodal marginal zone lymphoma, pediatric nodal marginal zone lymphoma, pediatric follicular lymphoma, primary cutaneous follicle centre lymphoma, T cell/histiocyte rich large B cell lymphoma, primary DLBCL of the CNS, primary cutaneous DLBCL, leg type, EBV-positive DLBCL of the elderly, DLBCL associated with chronic inflammation, lymphomatoid granulomatosis, primary mediastinal (thymic) large B cell lymphoma (PMLBCL), intravascular large B cell lymphoma, ALK-positive large B cell lymphoma, plasmablastic lymphoma, large B cell lymphoma arising in HHV8-associated multicentric Castleman disease, primary effusion lymphoma: B cell lymphoma, unclassifiable, with features intermediate between DLBCL and Burkitt lymphoma, and B cell lymphoma, unclassifiable, with features intermediate between DLBCL and classical Hodgkin's lymphoma. Further examples of B cell proliferative disorders include, but are not limited to, multiple myeloma (MM); low grade/follicular NHL; small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NI-HL; AIDS-related lymphoma; and acute lymphoblastic leukemia (ALL); chronic myeloblastic leukemia; and post-transplant lymphoproliferative disorder (PTLD). In particular instances, the B cell proliferative disorder may be NHL (e.g., DLBCL (e.g., relapsed or refractory DLBCL), PMLBCL, or FL) or CLL.

In particular, myeloid malignancies amenable to treatment with a cell therapy (CAR-T) or T/NK cell activating bispecific/multispecific antibody targeting an antigen (e.g., CD33, CD123, MPL, BST1, FLT2, IL1RAP etc.) expressed on myeloid cells in accordance with the methods described herein include acute myeloblasts leukemia, chronic neutrophilic leukemia, myeloid dendritic cell leukemia, accelerated phase chronic myelogenous leukemia, acute myelomonocytic leukemia, juvenile myelomonocytic leukemia, chronic myelomonocytic leukemia, acute basophilic leukemia, acute eosinophilic leukemia, chronic eosinophilic leukemia, acute megakaryoblastic leukemia, essential thrombocytosis, acute erythroid leukemia, polycythemia vera, myelodysplastic syndrome, acute panmyeloic leukemia, myeloid sarcoma, and acute biphenotypic leukaemia.

Exemplary solid tumor malignancies amenable to treatment with a cell therapy (CAR-T) or T/NK cell activating bispecific/multispecific antibody targeting an antigen (e.g., Mesothelin, IL13Ra2, Her2, ROR1, PTK7, DLL3, EGFR etc.) expressed on solid tumors in accordance with the methods described herein include breast, lung, colon, gastric, brain, kidney, bladder, prostate, ovarian, testicular, cervical, bladder, head and neck and skin cancers.

In some embodiments of any of the above aspects, the cell therapy or the T/NK cell activating antibody therapy is administered to the subject as a monotherapy.

In other embodiments of any of the above aspects, the cell therapy or the T/NK cell activating antibody therapy is administered to the subject as a combination therapy. In some embodiments, the cell therapy or the T/NK cell activating antibody therapy is administered to the subject concurrently with an additional therapeutic agent (e.g., atezolizumab). In other embodiments, the cell therapy or the T/NK cell activating antibody therapy is administered to the subject prior to the administration of an additional therapeutic agent (e.g., atezolizumab). In some embodiments, the additional therapeutic agent is atezolizumab. In some embodiments, the method further comprises administering to the subject a first dose of atezolizumab concurrently with the C2D1 of the T/NK cell activating antibody therapy on Day 1 of the second dosing cycle. In some embodiments, the method further comprises administering to the subject atezolizumab concurrently with the single dose of the T/NK cell activating antibody therapy of the one or more additional dosing cycles on Day 1 of the one or more additional dosing cycles. In some embodiments, atezolizumab is only administered to the subject concurrently with the cell therapy or the T/NK cell activating antibody therapy. In some embodiments, each dose of atezolizumab is about 1200 mg.

In yet other embodiments, the cell therapy or the T/NK cell activating antibody therapy is administered to the subject subsequent to the administration of an additional therapeutic agent (e.g., obinutuzumab (GAZYVA®) or tocilizumab (ACTEMRA®/RoACTEMRA®).

In some embodiments of any of the above aspects, the B cell proliferative disorder is a non-Hodgkin's lymphoma (NHL) or a chronic lymphoid leukemia (CLL). In some embodiments, the NHL is a diffuse-large B cell lymphoma (DLBCL). In some embodiments, the DLBCL is a relapsed or refractory DLBCL. In some embodiments, the NHL is a follicular lymphoma (FL). In some embodiments, the NHL is a primary mediastinal (thymic) large B cell lymphoma (PMLBCL).

In some embodiments of any of the above aspects, the administering is by intravenous infusion.

In some embodiments of any of the above aspects, the administering is subcutaneously.

For all the methods described herein, the cell therapy (e.g., CAR-T therapy) or the immune therapy (e.g., T/NK cell activating antibody therapy) would be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners. The cell therapy (e.g., CAR-T therapy) or the immune therapy (e.g., T/NK cell activating antibody therapy) need not be, but is optionally formulated with, one or more agents currently used to prevent or treat the disorder in question. The effective amount of such other agents depends on the amount of the cell therapy (e.g., CAR-T dose) or the immune therapy (e.g., T/NK cell activating antibody therapy) present in the formulation, the type of disorder or treatment, and other factors discussed above. The cell therapy (e.g., CAR-T therapy) or the immune therapy (T/NK cell activating antibody therapy) may be suitably administered to the patient over a series of treatments. The cell therapy (e.g., CAR-T therapy) or the immune therapy (T/NK cell activating antibody therapy) may be suitably administered to the patient in step-dose manner.

In some embodiments of any one the above aspects, the subject receiving the cell therapy or the immune therapy (e.g., T/NK cell activating antibody therapy) experiences a cytokine release syndrome (CRS) event, and the method further comprises administering to the subject an effective amount of an interleukin-6 receptor (IL-6R) antagonist (e.g., an anti-IL-6R antibody, e.g., tocilizumab (ACTEMRA®/RoACTEMRA®)) to manage the CRS event.

The National Cancer Institute (NCI) Common Terminology Criteria for Adverse Events (CTCAE) v4.0 includes a grading system for CRS, which was subsequently revised by Lee et al. (Blood. 124(2): 188-95, 2014) to define mild, moderate, severe, or life-threatening CRS regardless of the inciting agent.

In some embodiments, tocilizumab is administered intravenously to the subject as a single dose of about 8 mg/kg.

In other embodiments, the CRS event does not resolve or worsens within 24 hours of treating the symptoms of the CRS event, and the method further comprises administering to the subject one or more additional doses of the IL-6R antagonist (e.g., an anti-IL-6R antibody, e.g., tocilizumab) to manage the CRS event. In some embodiments, the CRS event does not resolve or worsens within 24 hours of treating the symptoms of the CRS event, and the method further comprises administering to the subject one or more doses of a C5 inhibitor (e.g., Ecolizumab, Ravulizumab, tesidolumab or 305 variant antibodies) to manage CRS event and/or CRES. In some embodiments, the one or more additional doses of tocilizumab is administered intravenously to the subject at a dose of about 8 mg/kg. In some embodiments, the method further comprises administering to the subject an effective amount of a corticosteroid. In some embodiments, the corticosteroid is administered intravenously to the subject. In some embodiments, the corticosteroid is methylprednisolone. In some embodiments, the methylprednisolone is administered at a dose of about 2 mg/kg per day. In other embodiments, the corticosteroid is dexamethasone. In some embodiments, the dexamethasone is administered at a dose of about 10 mg.

In some embodiments, the subject receiving the cell therapy or the T/NK cell activating antibody therapy receives the IMA. In some embodiments, the IMA is administered prior to the first dose of the IL-6R antagonist (e.g., an anti-IL-6R antibody, e.g., tocilizumab). In some embodiments, the IMA is administered prior to the first dose of the IL-1 antagonist (e.g., Anakinra). In some embodiments, the IMA is administered prior to the first dose of steroids (e.g., methylprednisolone or dexamethasone). In some embodiments, the IMA is administered prior to the first dose of a C5 inibitor (e.g., tesidolumab, eculizumab, 305 variant antibodies and a homologous antibody thereof described herein). In some embodiments, the IMA is administered after one or more doses of the IL-6R antagonist (e.g., an anti-IL-6R antibody, e.g., tocilizumab). In some embodiments, the IMA is administered after one or more doses of an IL-1 antagonist (e.g., Anakinra). In some embodiments, the IMA is administered after one or more doses of steroids (e.g., methylprednisolone or dexamethasone). In some embodiments, the IMA is administered after one or more doses of a C5 inibitor (e.g., tesidolumab, eculizumab, 305 variant antibodies and a homologous antibody thereof described herein). In some embodiments, the IMA is administered concurrent with the IL-6R antagonist (e.g., an anti-IL-6R antibody, e.g., tocilizumab). In some embodiments, the IMA is administered concurrent with one or more doses of an IL-1 antagonist (e.g., Anakinra). In some embodiments, the IMA is administered concurrent with steroids. In some embodiments, the IMA is administered concurrent with one or more doses of a C5 inibitor (e.g., tesidolumab, eculizumab, 305 variant antibodies and a homologous antibody thereof described herein).

In some embodiments, the method further includes administering a chemotherapeutic agent prior to administering the cell therapy or the T/NK cell activating antibody therapy. In some instances, the subject has been previously treated with a chemotherapeutic agent prior to the initiation of administration of the cell therapy or the T/NK cell activating antibody therapy. In some aspects, the chemotherapeutic agent includes an agent selected from the group consisting of cyclophosphamide, fludarabine, and/or a combination thereof. In some embodiments, the chemotherapeutic agent is administered between 2 and 5 days prior to the initiation of administration of the cell therapy or the T/NK cell activating antibody therapy. In some cases, the chemotherapeutic agent is administered at a dose of between at or about 1 g/m2 of the subject and at or about 3 g/m2 of the subject.

In some embodiments, toxicity for which an IMP is administered is a neurotoxicity (e.g., CRES). In some embodiments, a CNS-related outcome in the subject at day up to or up to about day 7, 8, 9, 10, 11, 12, 13, 14, 15, 16, 17, 18, 19, 20, 21, 22, 23, 24, 25, 26, 27, 28, 29 or 30 following administration of the therapy, e.g., CAR-T therapy or cell therapy or the T/NK cell activating antibody, is not detectable or is reduced as compared to a method including an alternative treatment regimen wherein the subject is administered the agent or other treatment after severe CRS or neurotoxicity has developed or after grade 2 or higher CRS or neurotoxicity has developed. In some embodiments, the toxic outcome is a symptom associated with grade 3 or higher neurotoxicity or is a symptom associated with grade 2 or higher CRS. In some embodiments, the toxic outcome is reduced by greater than 50%, 60%, 70%, 80%, 90% or more. In some cases, the toxic outcome is a symptom associated with grade 3 or higher neurotoxicity. In some embodiments, the toxic outcome is selected from among grade 3 or higher neurotoxicity include confusion, delirium, expressive aphasia, obtundation, myoclonus, lethargy, altered mental status, convulsions, seizure-like activity and seizures.

In some embodiments, the toxic outcome is grade 3 or higher CRS comprising one or more symptom selected from among persistent fever greater than at or about 38 degrees Celsius, for at least three consecutive days; hypotension requiring high dose vasopressor or multiple vasopressors; hypoxia, which optionally comprises (e.g., plasma oxygen (pO2) levels of less than at or about 90% and respiratory failure requiring mechanical ventilation. In some embodiments, the therapy is a cell therapy comprising a dosage of cells and the cells exhibit increased or prolonged expansion and/or persistence in the subject as compared to administration of the cell therapy (in the subject or in a corresponding subject in an alternative cohort or treatment group) using alternative treatment regimen, wherein said alternative treatment regimen comprises administering the cell therapy and subsequently administering the agent or other treatment after severe CRS has developed or after grade 2 or higher CRS has developed, and optionally wherein the subject in said alternative treatment regimen is not administered said agent, and optionally is not administered any other treatment designed to treat CRS or neurotoxicity, following the administration of the cells and prior to said development of grade 2 or higher CRS or severe CRS. In some embodiments, the increase in or prolonging of expansion and/or persistence is by 2-fold, 3-fold, 4-fold, 5-fold, 6-fold, 7-fold, 8-fold, 9-fold or 10-fold.

In some embodiments, the therapy is a cell therapy comprising a dosage of cells and the cells exhibit increased or prolonged expansion and/or persistence in the subject as compared to the administration of the cell therapy (in the subject or a corresponding subject in an alternative cohort or treatment group) using alternative treatment regimen. In some cases, said alternative treatment regimen comprises administering the cell therapy and subsequently administering the IMA or other treatment after severe CRS or neurotoxicity has developed or after grade 2 or higher CRS or neurotoxicity has developed. In some cases, the subject in said alternative treatment regimen is not administered said agent. In some instances, the subject in said alternative treatment regimen is not administered any other treatment designed to treat CRS or neurotoxicity, following the administration of the cells and prior to said development of grade 2 or higher CRS or severe CRS or grade 2 or higher neurotoxicity or severe neurotoxicity.

In some embodiments, the increase in or prolonging of expansion and/or persistence is by 2-fold, 3-fold, 4-fold, 5-fold, 6-fold, 7-fold, 8-fold, 9-fold or 10-fold.

In some embodiments, the cells exhibit the same or similar expansion and/or persistence in the subject than cells administered in a method including an alternative treatment regimen wherein the subject is administered the cell therapy but in the absence of the IMA. In some embodiments, the expansion and/or persistence is no more than 10-fold lower or reduced than in a method including an alternative treatment regimen wherein the subject is administered the cell therapy but in the absence of the IMA or the other treatment.

In some embodiment, the number of immune effector cells (e.g., CAR-T cells) measured in peripheral blood in a subject administered the cell therapy and an IMA is equal to or better than the number of immune effector cells (e.g., CAR-T cells) in a subject administered the cell therapy and an alternate regimen for controlling CRS/CRES. In an exemplary embodiment, the number of immune effector cells (e.g., CAR-T cells) are counted 2 days after completion of administration of the IMA or the alternate regimen for treatment of CRS/CRES. A number of techniques for measuring CAR-T cells are known in the art, such as qPCR and flow cytometry. In an embodiment, the number of immune effector cells (e.g., CAR-T cells) in a subject administered the cell therapy and an IMA is equal to or better than the number of immune effector cells (e.g., CAR-T cells) in a subject administered the cell therapy and steroids for controlling CRS/CRES. In an exemplary embodiment, the steroid is dexamethasone and the subject is administered dexamethasone at a dose of 10 mg IV every 6 hours.

In some embodiment, the expansion and/or persistence of immune effector cells (e.g., CAR-T cells) measured in peripheral blood in a subject administered the cell therapy and an IMA is equal to or better than the expansion and/or persistence of immune effector cells (e.g., CAR-T cells) in a subject administered the cell therapy and an alternate regimen for controlling CRS. The expansion and/or persistence of immune effector cells (e.g., CAR-T cells) are counted on 2 days, 10 days, 20 days, 30 days or 60 days after completion of administration of the IMA or the alternate regimen for treatment of CRS/CRES. A number of techniques for measuring expansion and/or persistence of CAR-T cells are known in the art, such as qPCR and flow cytometry. In an embodiment, the expansion and/or persistence of immune effector cells (e.g., CAR-T cells) in a subject administered the cell therapy and an IMA is equal to or better than the expansion and/or persistence of immune effector cells (e.g., CAR-T cells) in a subject administered the cell therapy and steroids for controlling CRS and/or CRES. In an exemplary embodiment, the steroid is dexamethasone and the subject is administered dexamethasone at a dose of 10 mg IV every 6 hours.

In some embodiment, the number of immune effector cells (e.g., CAR-T cells) measured in peripheral blood in a subject administered the cell therapy and an IMA is not more than 10 fold less than the number of immune effector cells (e.g., CAR-T cells) in a subject administered the cell therapy and an alternate regimen for controlling CRS/CRES where the number of immune effector cells (e.g., CAR-T cells) are counted 2 days after completion of administration of the IMA or the alternate regimen for treatment of CRS/CRES. A number of techniques for measuring CAR-T cells are known in the art, such as qPCR and flow cytometry. A number of alternate regimens for controlling CRS/CRES are known in the art, including steroids, Tocilizumab and Siltuximab. In an embodiment, the number of immune effector cells (e.g., CAR-T cells) in a subject administered the cell therapy and an IMA are no more than 10 fold less than the number of immune effector cells (e.g., CAR-T cells) in a subject administered the cell therapy and steroids for controlling CRS/CRES. In an exemplary embodiment, the steroid is dexamethasone and the subject is administered dexamethasone at a dose of 10 mg IV every 6 hours. In an exemplary embodiment, the steroid is Methylprednisolone and the subject is administered Methylprednisolone at a dose of 500 mg IV every 12 hours for 3 days followed by followed by 250 mg IV every 12 hours for 2 days, 125 mg IV every 12 hours for 2 days, 60 mg IV every 12 hours until CRS/CRES improvement to Grade 1 and then taper over 2 weeks. In an embodiment, the alternate regimen consists of Tocilizumab and Tocilizumab is administered at a dose of 8 mg/kg IV for up to 3 doses in a 24 hour period and maximum 4 doses. In an embodiment, the alternate regimen consists of siltuxiamab and siltuximab is administered at a dose of 11 mg/kg IV once.

In some embodiment, the expansion and/or persistence of immune effector cells (e.g., CAR-T cells) measured in peripheral blood in a subject administered the cell therapy and an IMA is equal to or better than the expansion and/or persistence of immune effector cells (e.g., CAR-T cells) in a subject administered the cell therapy and an alternate regimen for controlling CRS/CRES. The expansion and/or persistence of immune effector cells (e.g., CAR-T cells) are counted on 2 days, 10 days, 20 days, 30 days or 60 days after completion of administration of the IMA or the alternate regimen for treatment of CRS/CRES. A number of techniques for measuring expansion and/or persistence of CAR-T cells are known in the art, such as qPCR and flow cytometry. In an embodiment, the expansion and/or persistence of immune effector cells (e.g., CAR-T cells) in a subject administered the cell therapy and an IMA is equal to or better than the expansion and/or persistence of immune effector cells (e.g., CAR-T cells) in a subject administered the cell therapy and steroids for controlling CRS. In an exemplary embodiment, the steroid is dexamethasone and the subject is administered dexamethasone at a dose of 10 mg IV every 6 hours.

In some embodiment, the expansion and/or persistence of immune effector cells (e.g., CAR-T cells) measured in peripheral blood in a subject administered the cell therapy and an IMA is not more than 10 fold less than the expansion and/or persistence of immune effector cells (e.g., CAR-T cells) in a subject administered the cell therapy and an alternate regimen for controlling CRS where the expansion and/or persistence of immune effector cells (e.g., CAR-T cells) are counted 2 days, 5 days, 10 days, 30 days and 60 days after completion of administration of the IMA or the alternate regimen for treatment of CRS. A number of techniques for measuring CAR-T cells are known in the art, such as qPCR and flow cytometry. A number of alternate regimens for controlling CRS are known in the art, including steroids, Tocilizumab and Siltuximab. In an embodiment, the expansion and/or persistence of immune effector cells (e.g., CAR-T cells) in a subject administered the cell therapy and an IMA are no more than 10 fold less than the number of immune effector cells (e.g., CAR-T cells) in a subject administered the cell therapy and steroids for controlling CRS. In an exemplary embodiment, the steroid is dexamethasone and the subject is administered dexamethasone at a dose of 10 mg IV every 6 hours. In an exemplary embodiment, the steroid is Methylprednisolone and the subject is administered Methylprednisolone at a dose of 500 mg IV every 12 hours for 3 days followed by followed by 250 mg IV every 12 hours for 2 days, 125 mg IV every 12 hours for 2 days, 60 mg IV every 12 hours until CRS or CRES improvement to Grade 1 and then taper over 2 weeks. In an embodiment, the alternate regimen consists of Tocilizumab and Tocilizumab is administered at a dose of 8 mg/kg IV for up to 3 doses in a 24 hour period and maximum 4 doses. In an embodiment, the alternate regimen consists of siltuxiamab and siltuximab is administered at a dose of 11 mg/kg IV once.

In some embodiments, the cells exhibit the same or similar expansion and/or persistence in the subject than cells administered in a method including an alternative treatment regimen wherein the subject is administered the T/NK cell activating immune therapy (e.g., bispecific antibody) but in the absence of the IMA. In some embodiments, the expansion and/or persistence of immune cells (e.g., T cells) is no more than 10-fold lower or reduced than in a method including an alternative treatment regimen wherein the subject is administered the T/NK cell activating immune therapy (e.g., bispecific antibody) but in the absence of the IMA or the other treatment.

In some embodiment, the number of immune effector cells (e.g., T cells) measured in peripheral blood in a subject administered the T/NK cell activating immune therapy (e.g., bispecific antibody) and an IMA is equal to or better than the number of immune effector cells (e.g., T cells) in a subject administered the T/NK cell activating immune therapy (e.g., bispecific antibody) and an alternate regimen for controlling CRS/CRES. The number of immune effector cells (e.g., T cells) are counted 2 days after completion of administration of the IMA or the alternate regimen for treatment of CRS/CRES. A number of techniques for measuring T cells are known in the art, such as flow cytometry. In an embodiment, the number of immune effector cells (e.g., T cells) in a subject administered the T/NK cell activating immune therapy (e.g., bispecific antibody) and an IMA is equal to or better than the number of immune effector cells (e.g., T cells) in a subject administered the T/NK cell activating immune therapy (e.g., bispecific antibody) and steroids for controlling CRS/CRES. In an exemplary embodiment, the steroid is dexamethasone and the subject is administered dexamethasone at a dose of 10 mg IV every 6 hours.

In some embodiment, the expansion and/or persistence of immune effector cells (e.g., T cells) measured in peripheral blood in a subject administered the T/NK cell activating immune therapy (e.g., bispecific antibody) and an IMA is equal to or better than the expansion and/or persistence of immune effector cells (e.g., T cells) in a subject administered the T/NK cell activating immune therapy (e.g., bispecific antibody) and an alternate regimen for controlling CRS/CRES. The expansion and/or persistence of immune effector cells (e.g., T cells) are counted on 2 days, 10 days, 20 days, 30 days or 60 days after completion of administration of the IMA or the alternate regimen for treatment of CRS/CRES. A number of techniques for measuring expansion and/or persistence of CAR-T cells are known in the art, such as flow cytometry. In an embodiment, the expansion and/or persistence of immune effector cells (e.g., T cells) in a subject administered the T/NK cell activating immune therapy (e.g., bispecific antibody) and an IMA is equal to or better than the expansion and/or persistence of immune effector cells (e.g., T cells) in a subject administered the cell therapy and steroids for controlling CRS and/or CRES. In an exemplary embodiment, the steroid is dexamethasone and the subject is administered dexamethasone at a dose of 10 mg IV every 6 hours.

In some embodiment, the number of immune effector cells (e.g., T cells) measured in peripheral blood in a subject administered the T/NK cell activating immune therapy (e.g., bispecific antibody) and an IMA is not more than 10 fold less than the number of immune effector cells (e.g., T cells) in a subject administered the cell therapy and an alternate regimen for controlling CRS/CRES where the number of immune effector cells (e.g., T cells) are counted 2 days after completion of administration of the IMA or the alternate regimen for treatment of CRS/CRES. A number of alternate regimens for controlling CRS/CRES are known in the art, including steroids, Tocilizumab and Siltuximab. In an embodiment, the number of immune effector cells (e.g., T cells) in a subject administered the T/NK cell activating immune therapy (e.g., bispecific antibody) and an IMA are no more than 10 fold less than the number of immune effector cells (e.g., T cells) in a subject administered the T/NK cell activating immune therapy (e.g., bispecific antibody) and steroids for controlling CRS/CRES. In an exemplary embodiment, the steroid is dexamethasone and the subject is administered dexamethasone at a dose of 10 mg IV every 6 hours. In an exemplary embodiment, the steroid is Methylprednisolone and the subject is administered Methylprednisolone at a dose of 500 mg IV every 12 hours for 3 days followed by followed by 250 mg IV every 12 hours for 2 days, 125 mg IV every 12 hours for 2 days, 60 mg IV every 12 hours until CRS/CRES improvement to Grade 1 and then taper over 2 weeks. In an embodiment, the alternate regimen consists of Tocilizumab and Tocilizumab is administered at a dose of 8 mg/kg IV for up to 3 doses in a 24 hour period and maximum 4 doses. In an embodiment, the alternate regimen consists of siltuxiamab and siltuximab is administered at a dose of 11 mg/kg IV once.

In some embodiment, the expansion and/or persistence of immune effector cells (e.g., CAR-T cells) measured in peripheral blood in a subject administered the cell therapy and an IMA is equal to or better than the expansion and/or persistence of immune effector cells (e.g., CAR-T cells) in a subject administered the cell therapy and an alternate regimen for controlling CRS/CRES. The expansion and/or persistence of immune effector cells (e.g., CAR-T cells) are counted on 2 days, 10 days, 20 days, 30 days or 60 days after completion of administration of the IMA or the alternate regimen for treatment of CRS/CRES. A number of techniques for measuring expansion and/or persistence of CAR-T cells are known in the art, such as qPCR and flow cytometry. In an embodiment, the expansion and/or persistence of immune effector cells (e.g., CAR-T cells) in a subject administered the cell therapy and an IMA is equal to or better than the expansion and/or persistence of immune effector cells (e.g., CAR-T cells) in a subject administered the cell therapy and steroids for controlling CRS. In an exemplary embodiment, the steroid is dexamethasone and the subject is administered dexamethasone at a dose of 10 mg IV every 6 hours.

In some embodiment, the expansion and/or persistence of immune effector cells (e.g., CAR-T cells) measured in peripheral blood in a subject administered the cell therapy and an IMA is not more than 10 fold less than the expansion and/or persistence of immune effector cells (e.g., CAR-T cells) in a subject administered the cell therapy and an alternate regimen for controlling CRS where the expansion and/or persistence of immune effector cells (e.g., CAR-T cells) are counted 2 days, 5 days, 10 days, 30 days and 60 days after completion of administration of the IMA or the alternate regimen for treatment of CRS. A number of techniques for measuring CAR-T cells are known in the art, such as qPCR and flow cytometry. A number of alternate regimens for controlling CRS are known in the art, including steroids, Tocilizumab and Siltuximab. In an embodiment, the expansion and/or persistence of immune effector cells (e.g., CAR-T cells) in a subject administered the cell therapy and an IMA are no more than 10 fold less than the number of immune effector cells (e.g., CAR-T cells) in a subject administered the cell therapy and steroids for controlling CRS. In an exemplary embodiment, the steroid is dexamethasone and the subject is administered dexamethasone at a dose of 10 mg IV every 6 hours. In an exemplary embodiment, the steroid is Methylprednisolone and the subject is administered Methylprednisolone at a dose of 500 mg IV every 12 hours for 3 days followed by followed by 250 mg IV every 12 hours for 2 days, 125 mg IV every 12 hours for 2 days, 60 mg IV every 12 hours until CRS or CRES improvement to Grade 1 and then taper over 2 weeks. In an embodiment, the alternate regimen consists of Tocilizumab and Tocilizumab is administered at a dose of 8 mg/kg IV for up to 3 doses in a 24 hour period and maximum 4 doses. In an embodiment, the alternate regimen consists of siltuxiamab and siltuximab is administered at a dose of 11 mg/kg IV once.

In an embodiment, the effect of the IMA on the activation, proliferation, cytokine production, and cytotoxicity mediated by the immune effector cells (e.g., T cells or CAR-T cells) is reversible after the administration of IMA is stopped. In an embodiment, the effect of the IMA on the activation, proliferation, cytokine production, and cytotoxicity mediated by the immune effector cells (e.g., T cells or CAR-T cells) is reversed within about 2 hours, 4 hours, 6 hours, 8 hours, 12 hours, 24 hours, 36 hours, 48 hours, 72 hours, 96 hours, 7 days after the administration of IMA is stopped. A number of techniques for measuring the activation, proliferation, cytokine (e.g., IFNγ, TNFα, IL2 etc.) production, and cytotoxicity mediated by immune cells are known in the art.

In an embodiment, the effect of the IMA on the activation, proliferation, cytokine production, and cytotoxicity mediated by the immune effector cells (e.g., T cells or CAR-T cells) is more rapidly reversible after its administration is stopped as compared to the effect of an alternate regimen to control CRS/CRES. A number of alternate regimens for controlling CRS are known in the art, including steroids, Tocilizumab and Siltuximab.

In one embodiment, the IMA comprises a single chain variable fragment or an Fab fragment or an F(ab)2 fragment targeting an antigen that is also targeted by the immune effector cells or T/NK cell activating bispecific/multispecific antibody and the effect of such an IMA (i.e., scFv, Fab or (Fab')2)) on the activation, proliferation, cytokine production, and cytotoxicity mediated by the immune effector cells (e.g., T cells or CAR-T cells) is more rapidly reversible after its administration is stopped as compared to the effect of a corresponding full length antibody targeting the same antigen for the purpose of controlling CRS/CRES.

In an embodiment, the effect of the IMA on the activation, proliferation, cytokine production, and cytotoxicity mediated by the immune effector cells (e.g., T cells or CAR-T cells) is titrated by adjusting the dose and/or rate of administration of the IMA. In an exemplary embodiment, the IMA is administered by continuous intravenous infusion and effect of the IMA on the activation, proliferation, cytokine production, and cytotoxicity mediated by the immune effector cells (e.g., T cells or CAR-T cells) is titrated based on the rate of infusion.

In an exemplary embodiment, the IMA is administered by continuous intravenous infusion and effect of the IMA on controlling the signs and symptoms of CRS/CRES is titrated by adjusting its rate of infusion.

In some embodiments, the therapy is a cell therapy, comprising engineered and/or CAR-expressing cells. In some cases, the concentration or number of the engineered and/or CAR-expressing cells in the blood of the subject at day 30, day 60, or day 90 following initiation of administration of the therapy is at least at or about 1 engineered or CAR-expressing cells per microliter, at least 5% of the total number of peripheral blood mononuclear cells (PBMCs), at least or at least about $1\times10^4$ engineered or CAR-expressing cells, and/or at least 5,00 copies of CAR-encoding or engineered receptor-encoding DNA per micrograms DNA. In some embodiments, at day 30, 60, or 90 following the initiation of the administration of the therapy, the CAR-expressing and/or engineered cells are detectable in the blood or serum of the subject. In some instances, at day 30, 60, or 90 following the initiation of the administration of the therapy, the blood of the subject contains at least 20% CAR-expressing cells, at least 10 CAR-expressing cells per microliter or at least $1\times10^4$ CAR-expressing cells. In some cases, at day 30, 60, or 90 following the initiation of the administration of the therapy, the blood of the subject contains at least 50%, 60%, 70%, 80%, or 90% of a biologically effective dose of the cells. In some embodiments, at day 30, 60, or 90 following the initiation of the administration of the therapy, the blood of the subject contains at least 20% engineered and/or CAR-expressing cells, at least 10 engineered and/or CAR-expressing cells per microliter and/or at least $1\times10^4$ engineered and/or CAR-expressing cells. In some cases, at day 30, 60, or 90 following the initiation of the administration of the therapy, the subject exhibits a reduction or sustained reduction in burden of the disease or condition. In some cases, the reduction or sustained reduction in burden of the disease or condition is at or about or at least at or about 50, 60, 70, or 80% peak reduction following the therapy administration or reduction associated with effective dose.

In some embodiments, at day 30, 60 or 90 following the initiation of the administration of the therapy, the subject does not, and/or has not, following the cell therapy treatment, exhibited severe neurotoxicity, severe CRS, grade 2 or higher CRS, grade 2 or higher neurotoxicity, and/or has not exhibited seizures or other CNS outcome; or at day 30, 60, or 90 following the initiation of the administration of the therapy, less than or about less than 25%, less than or about less than 20%, less than or about less than 15%, or less than or about less than 10%) of the subjects so treated do not, and/or have not, following the cell therapy treatment, exhibited severe neurotoxicity, severe CRS, grade 2 or higher CRS, grade 2 or higher neurotoxicity, and/or have not exhibited seizures or other CNS outcome.

In some embodiments, the therapy is a cell therapy, comprising engineered and/or CAR-expressing cells; and the area under the curve (AUC) for blood concentration of engineered and/or CAR-expressing cells over time following the administration of the IMA is greater as compared to that achieved via a method comprising an alternative treatment regimen (e.g., steroids), such as where the subject is administered the cell therapy and is administered the IMA or other treatment at a time at which the subject exhibits a severe or grade 2 or higher or grade 3 or higher CRS or neurotoxicity.

In some embodiments, also provided are IMA or other treatment for use in the treatment, prevention, delay or attenuation of the development of a toxicity in a subject that has been previously administered a therapy, which therapy comprises an immunotherapy and/or a cell therapy. In some embodiments, (a) the agents, e.g., IMA or other treatment are administered to a subject: (i) at a time that is less than or no more than ten, seven, six, five, four or three days after initiation of the subject having been administered the therapy; and/or (ii) at a time at which the subject does not exhibit a sign or symptom of severe cytokine release syndrome (CRS) and/or does not exhibit grade 2 or higher CRS; and/or (iii) at a time at which the subject does not exhibit a sign or symptom of severe neurotoxicity and/or does not exhibit grade 2 or higher neurotoxicity; and/or (b) between the time of initiation of the subject having been administered the therapy and the time of the administration of the agent or other treatment, (i) the subject has not exhibited severe CRS and/or has not exhibited grade 2 or higher CRS and/or (ii) the subject has not exhibited severe neurotoxicity and/or does not exhibit grade 2 or higher neurotoxicity.

In some embodiments, the IMA is administered at a time at which the subject exhibits a sign or symptom of CRS and/or exhibits grade 1 CRS or is administered within 24 hours after the subject exhibits a first sign or symptom of grade 1 CRS following the administration of the therapy. In some embodiments, the sign or symptom of grade 1 CRS is a fever; and/or the IMA or other treatment is administered within 24 hours after the first sign of a fever following administration of the therapy.

In some embodiments, also provided are IMA for use in the treatment, prevention, delay or attenuation of the development of a toxicity in a subject that has been previously administered a therapy, which therapy comprises an immunotherapy and/or a cell therapy, wherein the IMA or other treatment is administered within 24 hours of the first sign of a fever following administration of the therapy.

In some embodiments, also provided are IMA for use as a medicament in treating, preventing, delaying, or attenuating the development of a toxicity in a subject that has been previously administered a therapy, which therapy comprises an immunotherapy and/or a cell therapy. In some embodiments, (a) the IMA is administered to a subject: (i) at a time that is less than or no more than ten, seven, six, five, four, three or 1 day after the subject having been administered the therapy; and/or (ii) at a time at which the subject does not exhibit a sign or symptom of severe cytokine release syndrome (CRS) and/or does not exhibit grade 2 or higher CRS; and/or (iii) at a time at which the subject does not exhibit a sign or symptom of severe neurotoxicity/CRES and/or does not exhibit grade 2 or higher neurotoxicity/CRES; and/or (b) between the time of initiation of the subject having been administered the therapy and the time of the administration of the IMA, (i) the subject has not exhibited severe CRS and/or has not exhibited grade 2 or higher CRS and/or (ii) the subject has not exhibited severe neurotoxicity and/or does not exhibit grade 2 or higher neurotoxicity.

In another aspect, the disclosure provides a method for use of a drug, e.g. antibody, capable of inhibiting the complement pathway, e.g. an anti-C5 antibody, for the prevention and treatment of cytokine release syndrome (CRS) and CRES and associated neurological complications seen after the administration of a cellular therapy, e.g., immune effector cell therapy, e.g., CAR-T therapy or bispecific T/NK cell engaging antibody therapy.

In a certain aspect, the drug may comprise a complement inhibitor, e.g. Coversin or an antibody capable of inhibiting the complement pathway, e.g. an anti-C5 antibody capable of inhibiting the complement pathway. In one aspect, the antibody may comprise a monoclonal antibody capable of inhibiting the complement pathway. In other aspects, the drug may comprise a human monoclonal antibody or a humanized monoclonal antibody capable of inhibiting the complement pathway, e.g. a human monoclonal or humanized monoclonal anti-C5 antibody capable of inhibiting the complement pathway.

In certain embodiments, a complement inhibitor may be an antibody capable of inhibiting complement, such as an antibody that can block the formation of the membrane attack complex (MAC). For example, an antibody complement inhibitor may include an antibody that binds C5. Such anti-C5 antibodies may directly interact with C5 and/or C5b, so as to inhibit the formation of and/or physiologic function of C5b.

Suitable anti-C5 antibodies are known to those of skill in the art. Antibodies can be made to individual components of activated complement, e.g., antibodies to C7, C9, etc. (see, e.g., U.S. Pat. No. 6,534,058; US patent application US 20030129187; and U.S. Pat. No. 5,660,825). WO2010015608 and WO199529697 teach antibodies which binds to C5 and inhibit cleavage into C5a and C5b thereby decreasing the formation not only of C5a but also the downstream complement components.

In certain embodiments, said antibody is a fully human Fc-silent™ IgG1/lambda monoclonal antibody that targets C5, such as tesidolumab. In an alternative embodiment, the antibody may be a humanized monoclonal antibody such as eculizumab, available from Alexion Pharmaceuticals, and sold under the trade name Soliris®. In an alternative embodiment, the antibody may be a humanized monoclonal antibody such as Ravulizumab. In an alternative embodiment, the antibody fragment is peculizumab, a Fab fragment of eculizumab. In an alternative embodiment, the antibody may be selected from the optimized variants of the 305 antibody described in WO2016098356A1 (as herein defined as "305 variant antibodies.

In another embodiment of the invention, the anti-C5 antibody is a homologous antibody of eculizumab (eculizumab homologous antibody), tesidolumab (tesidolumab homologous antibody) or a 305 variant antibody, e.g. an isolated recombinant homologous antibody According to the invention, there is also provided a functional protein comprising an antigen binding portion thereof that specifically bind to a C5 protein, and cross compete with eculizumab, ravulizumab, tesidolumab or a 305 variant antibody. In some embodiments, the present invention provides isolated anti-C5 antibodies or antigen binding fragments thereof that bind to the same epitope of C5 protein than eculizumab, ravulizumab, tesidolumab or a 305 variant antibody. In some embodiments, the antibodies of the invention are isolated monoclonal antibodies that specifically bind to a C5 protein. In some embodiments, the antibodies of the invention are isolated human or humanized monoclonal antibodies that specifically bind to a C5 protein. In some embodiments, the antibodies of the invention are isolated chimeric antibodies that specifically bind to a C5 protein. In some embodiments, the anti-C5 antibodies are single chain antibodies, e.g. Fab fragments, e.g. scFv.

The homologous antibody may retain the desired functional properties of binding to C5 and inhibiting cleavage of C5 into C5a and C5b, in particular the homologous antibody may retain the binding efficacy of the corresponding tesidolumab, eculizumab or 305 variant antibody.

Thus according to the invention the anti-C5 antibody may have full length heavy and light chain amino acid sequences, variable region heavy and light chain amino acid sequences or heavy and light chain CDR amino acid sequences that are homologous to the amino acid sequences of tesidolumab or eculizumab or a 305 variant antibody as described in WO2017064615.

In some embodiments, the homologous antibody comprises some of the heavy and light chain amino acid sequences, in particular the heavy and light chain CDR amino acid sequences, that are 100% identical to the corresponding tesidolumab, eculizumab or 305 variant antibody sequences, and the other amino acid sequences that are about 80 to 99% identical to the corresponding tesidolumab, eculizumab or 305 variant antibody sequences.

In some embodiments, the homologous antibody comprises some of the heavy and light chain amino acid sequences, in particular the heavy and light chain CDR amino acid sequences, that are more than 80%, 85%, 90%, 95%, 99% identical to the corresponding tesidolumab, eculizumab or 305 variant antibody sequences, and the other amino acid sequences that are about 80 to 99% identical to the corresponding tesidolumab, eculizumab or 305 variant antibody sequences.

Furthermore, in another embodiment, modifications can be made to improve one or more binding properties (e.g., affinity) of the antibody of interest, known as "affinity maturation". Site-directed mutagenesis or PCR-mediated mutagenesis can be performed to introduce the mutation(s) and the effect on antibody binding, or other functional property of interest, can be evaluated in in vitro or in vivo assays. Conservative modifications can be introduced and the mutations may be amino acid substitutions, additions or deletions. Moreover, typically no more than one, two, three, four or five residues within a CDR region are altered.

In other aspects, the complement inhibitor is Coversin. Coversin, in development by *Akari* Therapeutics, is a recombinant small protein derived from the saliva of the tick *Ornithodoros moubata*. Coversin binds to complement factor C5 and inhibits activation of C5, the release of C5a and the formation of the membrane attack complex.

Disclosed also is a method of treating cell therapy associated CRES and CRS in a subject in need thereof.

The method may comprise the step of administering a drug, e.g. Coversin, or an antibody capable of inhibiting terminal complement, e.g. an anti-C5 antibody. The terminal complement may comprise a monoclonal antibody capable of inhibiting terminal complement, or in another embodiment, a human or humanized monoclonal antibody capable of inhibiting terminal complement. In one embodiment, the antibody may be tesidolumab or a homologous antibody thereof as herein above defined. In another embodiment, the antibody may be eculizumab or a homologous antibody thereof as herein above defined. In another embodiment the antibody may be a 305 variant antibody as described in Tables 7 and 8 of WO2016098356A1 ("305 variant antibody").

In some embodiments, the subject is a human e.g. a patient. The patient may be an adult of any weight or any patient with a body weight that is greater than or equal to 40 kg. Alternatively, the patient may have a body weight that is less than 40 kg but greater than or equal to 30 kg, a body weight that is less than 30 kg but greater than or equal to 20 kg, a body weight that is less than 20 kg but greater than or equal to 10 kg.

In some embodiments, the subject is a child >two years old. In an alternative embodiment, the subject is a child greater than 2 years old but less than 12 years old. In an alternative embodiment, the subject is older than or equal to 12 years old. In an alternative embodiment, the subject is an adult older than or equal to 16 years old, e.g. 18 years old.

Suitable methods for identifying a subject as one having, suspected of having or at risk for developing CRES are known in the art of medicine. Symptoms include altered mental status, confusion, headaches, aphasia, seizure, brain edema and coma. A variety of tests, such can be performed on a subject to determine whether the subject has CRES. In addition, laboratory tests can be performed to identify patients at high risk of CRES, such as Elevated lactate dehydrogenase (any elevation above normal range);

Thrombocytopenia with platelet count <50×10e9/L or greater than >50% decrease in platelet count from the highest value achieved after cell therapy;

Anemia below lower limit of normal or anemia requiring transfusion support as per center standard;

Schistocytes on peripheral blood smear (>2 per HPF) or histologic evidence of Microangiopathy; and/or Low Haptoglobin level.

Prior to treatment the subject may receive *N. meningitides* vaccine(s). Such vaccine(s) should take into account the serotypes prevalent in the geographic areas in which the subject is being treated. In addition, subjects less than 18 years old may be vaccinated for the prevention of *S. pneumoniae* and *H. influenzae* type b.

According to the invention, there is provided a dosing regimen for treating or preventing CRES, wherein said regime comprises administering a C5 inhibitor, e.g. an anti-C5 antibody, e.g. eculizumab, ravulizumab, tesidolumab, a 305 variant antibody, or an homologous antibody thereof as herein above defined, e.g. comprises administering tesidolumab.

In one aspect, the administration of the drug, e.g. the antibody, e.g. the anti-C5 antibody as herein defined, may be repeated every day, or every two days, or every three days, every 4 days, every 5 days, every 6 days, every 7 days, every 8 days, every 9 days, every 10 days. In certain aspects, the drug, e.g. the anti-C5 antibody as herein defined, is administered weekly.

In another embodiment, the drug, e.g. the antibody, e.g. the anti-C5 antibody as herein defined, is administered weekly during 1 to 5 weeks, e.g. during 2 weeks, e.g. during 3 weeks, e.g. during 4 weeks, and then is administered every 2 weeks or every 3 weeks.

The drug, e.g. the antibody, e.g. the anti-C5 antibody as herein defined, may be used in at least one dose, or at least two doses, or at least three doses, or at least four doses, or at least five doses, or at least six doses, or at least seven doses, or at least eight doses, or at least nine doses, or at least 10 doses, or at least 11 doses, or at least 12 doses, or at least 13 doses, or at least 14 doses, or at least 15 doses, or at least 16 doses, or at least 17 doses, or at least 18 doses, or at least 19 doses, or at least 20 doses, or in certain aspects, even more doses. In one aspect, the use may be carried out until a hematological response or a complete disease response is achieved in the subject.

In certain aspects, the administration of the drug, e.g. the antibody, e.g. the anti-C5 antibody, e.g. anti-C5 antibody selected from the group consisting of eculizumab, ravulizumab, tesidolumab, a 305 variant antibody and a homologous antibody thereof as herein above defined, may be carried out over a period of about three to about 30 weeks, or about four to about 30 weeks, or longer, e.g. about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks. During that period of treatment, e.g. during 1 to 30 weeks, e.g. during 1 to 20 weeks, e.g. during 1 to 17 weeks, e.g. during 1 to 15 weeks, e.g. during 1 to 12 weeks, the drug, e.g. the antibody, e.g. the anti-C5 antibody as herein defined, e.g. tesidolumab, may be administered weekly.

In other aspects, the administration of the drug, e.g. the antibody, e.g. the anti-C5 antibody, e.g. eculizumab, ravulizumab, tesidolumab, a 305 variant antibody, or a homologous antibody thereof as herein above defined, may be carried out over a period of up to 50 weeks, e.g. up to 45 weeks, e.g. up to 40 weeks, e.g. up to 35 weeks, e.g. up to 30 weeks.

In another aspect, the administration of the drug, e.g. the antibody, e.g. the anti-C5 antibody, e.g. eculizumab, ravulizumab, tesidolumab, a 305 variant antibody, or a homologous antibody thereof as herein above defined, may be carried out over a period of 1 month, 2 months, 3 months, 4 months, 5 months, 6 months or longer, e.g. one year or longer. During that period of treatment, the drug, e.g. the antibody, e.g. the anti-C5 antibody as herein defined, e.g. tesidolumab, may be administered weekly.

In another aspect, the administration of the drug, e.g. the antibody, e.g. the anti-C5 antibody, e.g. eculizumab, ravulizumab, tesidolumab, a 305 variant antibody, or a homologous antibody thereof as herein above defined, may be carried out over a period between 1 to 6 months, e.g. 1 to 5 months, e.g. 1 to 4 months, e.g. 1 and 3 months, e.g. 2 to 6 months, e.g. 2 to 5 months, e.g. 2 to 4 months, e.g. 2 to 3 months, e.g. 3 to 6, e.g. 3 to 5 months, e.g. 3 to 4 months, e.g. 4 to 6 months, e.g. 4 to 5 months, e.g. 5 to 6 months. During that period of treatment, the drug, e.g. the antibody, e.g. the anti-C5 antibody as herein defined, e.g. tesidolumab, may be administered weekly.

In some aspects, the C5 inhibitor, e.g. the anti-C5 antibody, e.g. eculizumab, ravulizumab, tesidolumab, a 305 variant antibody, or a homologous antibody thereof as herein above defined, is administered at two different dosages, firstly at an induction dose during a first period of time, also called induction phase, and later at a second different dose, during a maintenance period. The total duration of the induction phase plus the maintenance period may be as defined herein above.

The induction phase may last 1 to 8 weeks, e.g. 1 to 6 weeks, e.g. 1 to 4 weeks, e.g. 1 week, e.g. 2 weeks, e.g. 3 weeks, e.g. 4 weeks, e.g. 5 weeks, e.g. 6 weeks, e.g. 7 weeks, e.g. 8 weeks, e.g. for an C5 inhibitor that is an anti-C5 antibody selected from the group selected from eculizumab, ravulizumab, tesidolumab, a 305 variant antibody and a homologous antibody thereof as herein above defined, e.g. eculizumab, ravulizumab, tesidolumab or a 305 variant antibody.

The maintenance period may last 1 to 11 months, e.g. 1 to 8 months, e.g. 1 to 6 months, e.g. 1 to 4 months, e.g. 2 to 6 months, e.g. 2 to 5 months, e.g. 2 to 4 months, e.g. 3 to 6 months, e.g. 3 to 4 months, e.g. 3 months, e.g. 4 months, e.g. 5 months, e.g. 6 months, e.g. for an C5 inhibitor that is an anti-C5 antibody selected from the group selected from eculizumab, ravulizumab, tesidolumab, a 305 variant antibody and a homologous antibody thereof as herein above defined, e.g. eculizumab, ravulizumab, tesidolumab or a 305 variant antibody.

The induction dose may be about 2000 mg, 1700 mg, e.g. about 1500 mg, e.g. about 1400 mg, e.g. about 1300 mg, e.g. about 1200 mg, e.g. about 1100 mg, e.g. about 1000 mg, e.g. about 900 mg, e.g. about 800 mg, of the anti-C5 antibody, e.g. tesidolumab, eculizumab, a 305 variant antibody or a homologous antibody thereof as herein above defined. For example for subjects weighing 40 kg or greater, about 900 mg, e.g. about 800 mg, e.g. about 700 mg, e.g. about 600 mg tesidolumab, eculizumab, a 305 variant antibody or a homologous antibody thereof as herein above defined, for subjects weighing about 30 kg to about 40 kg; about 600 mg tesidolumab, eculizumab, a 305 variant antibody or a homologous antibody thereof as herein above defined, for subjects weighing about 20 kg to about 30 kg; about 600 mg tesidolumab, eculizumab, a 305 variant antibody or an homologous antibody thereof as herein above defined, for subjects weighing about 10 kg to about 20 kg; about 300 mg tesidolumab, eculizumab, or a 305 variant antibody or a homologous antibody thereof as herein above defined, for subjects weighing about 5 kg to about 10 kg.

The induction dose of the C5 inhibitor, e.g. anti-C5 antibody, e.g. an anti-C5 antibody selected from the group selected from eculizumab, ravulizumab, tesidolumab, a 305 variant antibody and a homologous antibody thereof as herein above defined, e.g. eculizumab, ravulizumab, tesidolumab, or a 305 variant antibody, may be comprised in a range of about 10 mg/kg to 40 mg/kg, e.g. about 10 mg/kg to 35 mg/kg, e.g. about 10 mg/kg to 30 mg/kg, e.g. about 10 mg/kg to 25 mg/kg, e.g. about 10 mg/kg to 20 mg/kg, e.g. is about 40 mg/kg, e.g. about 35 mg/kg, e.g. about 30 mg/kg, e.g. about 25 mg/kg, e.g. about 20 mg/kg, e.g. about 15 mg/kg, e.g. about 10 mg/kg. In one aspect the induction dose is about 15 mg/kg, e.g. for an C5 inhibitor that is an anti-C5 antibody selected from the group selected from eculizumab, ravulizumab, tesidolumab or a 305 variant antibody, and a homologous antibody thereof as herein above defined, e.g. eculizumab, ravulizumab, tesidolumab or a 305 variant antibody. In another aspect the induction dose is about 20 mg/kg, e.g. for an C5 inhibitor that is an anti-C5 antibody selected from the group selected from eculizumab, ravulizumab, tesidolumab or a 305 variant antibody, and a homologous antibody thereof as herein above defined, e.g. eculizumab, ravulizumab, tesidolumab or a 305 variant antibody. In a further aspect the induction dose is about 25 mg/kg, e.g. in case of an anti-C5 antibody selected from the group selected from eculizumab, ravulizumab, tesidolumab a 305 variant antibody, and a homologous antibody thereof as herein above defined, e.g. eculizumab, ravulizumab, tesidolumab or a 305 variant antibody.

The maintenance dose of the drug of the invention may be about 1500 mg, about 1200 mg, about 1000 mg, about 800 mg, about 700 mg, about 500 mg, about 400 mg, about 300 mg, e.g. of the anti-C5 antibody, e.g. tesidolumab, eculizumab, a 305 variant antibody or a homologous antibody thereof as herein above defined. For example the maintenance dose may be comprised between about 300 mg to about 1500 mg, e.g. about 300 mg to about 1200 mg, e.g. about 300 mg to about 1000 mg, e.g. about 300 mg to about 800 mg, e.g. about 400 mg to about 1500 mg, e.g. about 400 mg to about 1200 mg, e.g. about 400 mg to about 1000 mg, e.g. about 400 mg to about 800 mg, e.g. about 500 mg to about 1500 mg, e.g. about 500 mg to about 1200 mg, e.g. about 500 mg to about 1000 mg, e.g. about 500 mg to about 800 mg, e.g. in case of an anti-C5 antibody selected from the group selected from eculizumab, ravulizumab, tesidolumab a 305 variant antibody and a homologous antibody thereof as herein above defined, e.g. eculizumab, ravulizumab, tesidolumab or a 305 variant antibody.

For example for subjects weighing 40 kg or greater, about 600 mg, e.g. about 400 mg, about 300 mg, of an anti-C5 antibody selected from the group selected from eculizumab, ravulizumab, tesidolumab, a 305 variant antibody, and an homologous antibody thereof as herein above defined, e.g. eculizumab, ravulizumab, tesidolumab or a 305 variant antibody.

The maintenance dose may be comprised in a range of about 5 g/kg to 25 mg/kg, e.g. about 5 mg/kg to 20 mg/kg, e.g. about 5 mg/kg to 10 mg/kg, e.g. is about 30 mg/kg, e.g. about 25 mg/kg, e.g. about 20 mg/kg, e.g. about 15 mg/kg, e.g. about 10 mg/kg, e.g. about 5 mg/kg, e.g. in case of an anti-C5 antibody selected from the group selected from eculizumab, ravulizumab, tesidolumab, a 305 variant antibody and a homologous antibody thereof as herein above defined, e.g. eculizumab, ravulizumab, tesidolumab or a 305 variant antibody.

In one aspect the maintenance dose is about 5 mg/kg, e.g. in case of an anti-C5 antibody selected from the group selected from eculizumab, ravulizumab, tesidolumab, a 305 variant antibody, and a homologous antibody thereof as herein above defined, e.g. eculizumab, ravulizumab, tesidolumab or a 305 variant antibody.

In another aspect the induction dose is about 10 mg/kg. In a further aspect the induction dose is about 15 mg/kg, e.g. in case of an anti-C5 antibody selected from the group selected from eculizumab, ravulizumab, tesidolumab, a 305 variant antibody and a homologous antibody thereof as herein above defined, e.g. eculizumab, ravulizumab, tesidolumab or a 305 variant antibody.

In certain aspects wherein the drug is an anti C5 antibody, e.g. eculizumab, ravulizumab, tesidolumab, a 305 variant antibody or a homologous antibody thereof as herein above defined, the administration step may be carried until is attained a blood serum level of greater than or at least about 99 μg/mL, or at least or greater than about 100 μg/mL, or at least or greater than about 200 μg/ml, or at least or greater than about 300 μg/ml. The administration step may be repeated daily, or every two days, or every three days, or every 4 days, or every 5 days, or every 6 days, or every 7 days, until a serum level of greater than or at least about 99 μg/mL, or at least or greater than about 100 μg/mL, or at least or greater than about 150 μg/ml, or at least or greater than about 200 μg/ml, or at least or greater than about 300 μg/ml is achieved in the subject. The administration step may be repeated daily, or every two days, or every three days until a serum level of greater than or at least about 99 μg/mL, or at least or greater than about 100 μg/mL, or at least or greater than about 200 μg/ml, or at least or greater than about 300 μg/ml is achieved in the subject. Determination of the dosage in a patient based on patient weight will be readily understood by one of ordinary skill in the art.

The administration step may be carried out in a manner sufficient to achieve a therapeutic level of the C5 inhibitor, in particular of anti-C5 antibody e.g. selected from the group selected from eculizumab, ravulizumab, tesidolumab, or a 305 variant antibody and a homologous antibody thereof as herein above defined, e.g. eculizumab, ravulizumab, tesidolumab or a 305 variant antibody in the subject. The administration step may comprise at least one dose, or at least two doses, or at least three doses, or at least four doses, or, in some aspects, more than four doses.

According to the invention, the C5 inhibitor, e.g. the anti-C5 antibody, e.g. eculizumab, ravulizumab, tesidolumab, a 305 variant antibody or a homologous antibody thereof as defined herein, may further comprise the step of measuring total complement activity (CH50) to obtain a CH50 measurement, wherein the subject is administered the C5 inhibitor until the CH50 measurement obtained from the patient is from about 0-3 CAE units as measured by enzyme immunoassay, or wherein the CH50 measurement is 0-15 CH50 units as measured using a hemolytic method using standardized sheep erythrocytes.

In certain aspects, there is provided a method for treating or preventing CRES and/or CRS, which comprises the step of administering the C5 inhibitor, e.g. the anti-C5 antibody, e.g. eculizumab, ravulizumab, tesidolumab, a 305 variant antibody or a homologous antibody thereof as hereinabove described.

In another embodiment, there is provided a method for treating or preventing CRES, which comprises the steps of a) measuring total complement activity (CH50) prior to treatment with a complement inhibitor, e.g. the anti-C5 antibody, e.g. eculizumab, ravulizumab, tesidolumab, a 305 variant antibody or a homologous antibody thereof as herein above defined, to obtain an initial CH50 measurement;
b) administering said complement inhibitor as defined in a); and
c) measuring total CH50 activity after administration of said complement inhibitor to obtain a post-treatment CH50 measurement, wherein said complement inhibitor is administered until said post-treatment CH50 measurement is from about 0-3 CAE units as measured by enzyme immunoassay, or wherein the CH50 measurement is 0-15 CH50 units as measured using a hemolytic method using standardized sheep erythrocytes.

The administration step may comprise administering an anti-C5 antibody, e.g. tesidolumab, eculizumab, a 305 variant antibody or a homologous antibody thereof as herein above defined, and the administration step may be carried out for a period of time sufficient to resolve CRES and/or CRS. In some aspects, the administration step is carried out over a period as herein above defined, e.g. of about two to 30 weeks, e.g. three to about 15 weeks, e.g. four to about 17 weeks, or up to 20 weeks, or up to 25 weeks, or until the anti-C5 antibody, e.g. tesidolumab, eculizumab, a 305 variant antibody or a homologous antibody thereof as herein above defined, is administered at a dosage sufficient to reduce CH50 levels to 0-3 CAE units as measured by enzyme immunoassay, or wherein the CH50 measurement is 0-15 CH50 units as measured using a hemolytic method using standardized sheep erythrocytes.

The administration step may comprise administering the anti-C5 antibody, e.g. tesidolumab, eculizumab, a 305 variant antibody or a homologous antibody thereof as herein above defined, and the administration step may be carried out for a period of time as herein above defined, e.g. sufficient to achieve a favorable neurological response, wherein a favorable neurological response comprises improvement in or resolution of neurological manifestations of CRES; or sufficient to adequately suppress CH50 levels. The neurological manifestations may include, but are not limited to, headache, altered mental status, confusion, aphasia, seizures, brain edema and coma. In addition, the administration may continue until resolutions of markers of CRES and CRS. The laboratory markers may include, but are not limited to, normalization of CSF findings, normalization of LDH, resolution of need for red cell and platelet transfusions, and disappearance of schistocytes, or any other such criteria as will be readily understood by one of ordinary skill in the art. For example, the administration can be continued until Schistocytes <2/microscopic high power field (HPF) is attained.

The administration step may be carried out over a period of time sufficient to achieve a complete response, wherein the complete response comprises normalization of said subject's neurological parameters as will be readily understood by one of ordinary skill in the art.

In certain aspects, the subject may be administered the drug, e.g. the anti-C5 antibody, e.g. tesidolumab, eculizumab, a 305 variant antibody or a homologous antibody thereof as herein above defined, at the same dose during the period of treatment as hereinabove defined, e.g. multiple times a day, daily, weekly, or monthly. If the initial or subsequent dose does not resolve CRES and/or CRS or is not sufficient to achieve a favorable hematologic response as herein above defined, or not sufficient to adequately suppress CH50 level, an additional dose may be administered on a daily, weekly, or monthly basis. In such cases, the additional dose may be a larger dose than the initial or most recent dose administered. In certain aspects, the dose may be increased by about 100 mg, or about 200 mg, or about 300 mg, or about 400 mg, or about 500 mg.

As used herein 'adequately suppressed CH50 level' refers to 0-3 CAE units as measured by enzyme immunoassay, or 0-15 CH50 units as measured using a hemolytic method using standardized sheep erythrocytes, as described herein.

In one aspect, a method of determining the relative levels of a complement inhibitor in a subject administered a complement inhibitor is disclosed. In this aspect, the method may comprise the step of measuring total complement activity (CH50) in a sample obtained from the subject. The total complement inhibitor may comprise, for example, tesidolumab, eculizumab or a 305 variant antibody.

In one aspect, there is provided a method of optimizing an anti-C5 antibody, e.g. tesidolumab, eculizumab, a 305 variant antibody or a homologous antibody thereof as herein above defined, dosing schedule in a subject having any syndrome of CRES and/or CRS or not, is disclosed. In this aspect, the method may comprise the steps of a) determining total complement activity (CH50) in said subject who is treated by an induction dose of said anti-C5 antibody;
b1) either administering a second induction dose if CH50 levels are not adequately suppressed; or
b2) administering a weekly induction dose if CH50 levels are adequately suppressed;
c) administering an induction dose increased, by from about 100 mg to about 400 mg, e.g. about 300 mg, if CH50 levels are inadequately suppressed after said second induction dose;
wherein said subject is administered the anti-05 antibody, e.g. tesidolumab, eculizumab, a 305 variant antibody or a homologous antibody thereof as herein above defined, until neurological signs of CRES are resolved, e.g. resolution of neurological markers; or sufficient to adequately suppress CH50 levels, as hereinabove defined.

The method may further comprise the step of providing a maintenance dose to maintain CH50 suppression.

The drug, e.g. the antibody, e.g. the anti-05 antibody as defined herewith, may be is administered via any method as is known in the art, for example, intravenously, subcutaneously, intramuscularly, and/or orally.

In other embodiments, the CRES/CRS event, and the method further comprises administering to the subject one or more additional doses of the anti-05 antibody, e.g. tesidolumab, eculizumab, a 305 variant antibody or a homologous antibody thereof as herein above defined.

In some embodiments, the CRES/CRS event does not resolve or worsens within 24 hours of treating the symptoms of the CRS event, and the method further comprises administering to the subject one or more doses of a IL6R antagonist (e.g., tocilizumab) to manage CRS event and/or CRES. In some embodiments, the one or more additional doses of tocilizumab is administered intravenously to the subject at a dose of about 8 mg/kg. In some embodiments, the method further comprises administering to the subject an effective amount of a corticosteroid. In some embodiments, the corticosteroid is administered intravenously to the subject. In some embodiments, the corticosteroid is methylprednisolone. In some embodiments, the methylprednisolone is administered at a dose of about 2 mg/kg per day. In other embodiments, the corticosteroid is dexamethasone. In some embodiments, the dexamethasone is administered at a dose of about 10 mg.

In some embodiments, the subject receiving the cell therapy or the T/NK cell activating antibody therapy receives the C5 inhibitor therapy. In some embodiments, the C5 inhibitor is administered prior to the first dose of the IL-6R antagonist (e.g., an anti-IL-6R antibody, e.g., tocilizumab). In some embodiments, the C5 inhibitor is administered prior to the first dose of the IL-1 antagonist (e.g., Anakinra). In some embodiments, the C5 inhibitor is administered prior to the first dose of steroids (e.g., methylprednisolone or dexamethasone). In some embodiments, the C5 inhibitor is administered after one or more doses of the IL-6R antagonist (e.g., an anti-IL-6R antibody, e.g., tocilizumab). In some embodiments, the C5 inhibitor is administered after one or more doses of an IL-1 antagonist (e.g., Anakinra). In some embodiments, the C5 inhibitor is administered after one or more doses of steroids (e.g., methylprednisolone or dexamethasone). In some embodiments, the C5 inhibitor is administered concurrent with the IL-6R antagonist (e.g., an anti-IL-6R antibody, e.g., tocilizumab). In some embodiments, the C5 inhibitor is administered concurrent with one or more doses of an IL-1 antagonist (e.g., Anakinra). In some embodiments, the C5 inhibitor is administered concurrent with steroids.

In some embodiments, the method further includes administering a chemotherapeutic agent prior to administering the cell therapy or the T/NK cell activating antibody therapy. In some instances, the subject has been previously treated with a chemotherapeutic agent prior to the initiation of administration of the cell therapy or the T/NK cell activating antibody therapy. In some aspects, the chemotherapeutic agent includes an agent selected from the group consisting of cyclophosphamide, fludarabine, and/or a combination thereof. In some embodiments, the chemotherapeutic agent is administered between 2 and 5 days prior to the initiation of administration of the cell therapy or the T/NK cell activating antibody therapy. In some cases, the chemotherapeutic agent is administered at a dose of between at or about 1 g/m2 of the subject and at or about 3 g/m2 of the subject.

In some embodiments, also provided are uses of agents or other treatment for the manufacture of a medicament for treating, preventing, delaying, or attenuating the development of a toxicity in a subject that has been previously administered a therapy, which therapy comprises an immunotherapy and/or a cell therapy, wherein the agent or other treatment is administered within 24 hours of the first sign of a fever following administration of the therapy.

As used herein, the term "pharmaceutical composition" relates to a composition which is suitable for administration to a subject in need thereof.

In one embodiment, the pharmaceutical composition of the disclosure comprises one or a plurality of the IMA and/or C5 inhibitor described herein, typically in a therapeutically effective amount, a β-cyclodextrin and a buffer. By "therapeutically effective amount" is meant an amount of said construct that elicits the desired therapeutic effect. Therapeutic efficacy and toxicity can be determined by standard pharmaceutical procedures in cell cultures or experimental animals, e.g., $ED_{50}$ (the dose therapeutically effective in 50% of the population) and $LD_{50}$ (the dose lethal to 50% of the population). The dose ratio between therapeutic and toxic effects is the therapeutic index, and it can be expressed as the ratio, ED50/LD50. Pharmaceutical compositions that exhibit large therapeutic indices are typically used.

Besides the β-cyclodextrin and the buffer, the pharmaceutical composition may optionally comprise one or more further excipients as long as they do not reduce or abolish its advantageous properties as described herein, and in particular its stability.

Excipients can be used in the disclosure for a wide variety of purposes, such as adjusting physical, chemical, or biological properties of formulations, such as adjustment of viscosity, and or processes of the disclosure to further improve effectiveness and or to further stabilize such formulations and processes against degradation and spoilage due to, for instance, stresses that occur during manufacturing, shipping, storage, pre-use preparation, administration, and thereafter. The term "excipient" generally includes fillers, binders, disintegrants, coatings, sorbents, antiadherents, glidants, preservatives, antioxidants, flavoring, coloring, sweeting agents, solvents, co-solvents, buffering agents, chelating agents, viscosity imparting agents, surface active agents, diluents, humectants, carriers, diluents, preservatives, emulsifiers, stabilizers and tonicity modifiers.

Acceptable excipients are pharmaceutically acceptable, i.e., nontoxic to recipients at the dosages and concentrations employed.

Exemplary excipients include, without limitation: amino acids such as glycine, alanine, glutamine, asparagine, threonine, proline, 2-phenylalanine, including charged amino acids, such as lysine, lysine acetate, arginine, glutamate and/or histidine; preservatives, including antimicrobials such as antibacterial and antifungal agents; antioxidants such as ascorbic acid, methionine, sodium sulfite or sodium hydrogen-sulfite; buffers, buffer systems and buffering agents which are used to maintain the composition at physiological pH or at a slightly lower pH, typically within a pH range of from about 5 to about 8 or 9; examples of buffers are borate, bicarbonate, Tris-HCI, citrates, phosphates or other organic acids, succinate, phosphate, histidine and acetate; for example Tris buffer of about pH 7.0-8.5, or acetate buffer of about pH 4.0-5.5; non-aqueous solvents such as propylene glycol, polyethylene glycol, vegetable oils such as olive oil, and injectable organic esters such as ethyl oleate; aqueous carriers including water, alcoholic/aqueous solutions, emulsions or suspensions, including saline and buffered media; biodegradable polymers such as polyesters; bulking agents such as mannitol or glycine; chelating agents such as ethylenediamine tetraacetic acid (EDTA); isotonic and absorption delaying agents; complexing agents such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); carbohydrates may be non-reducing sugars, such as trehalose, sucrose, octasulfate, sorbitol or xylitol; (low molecular weight) proteins, polypeptides or proteinaceous carriers such as human or bovine serum albumin, gelatin or immunoglobulins, typically of human origin; coloring and flavouring agents; sulfur containing reducing agents, such as glutathione, thioctic acid, sodium thioglycolate, thioglycerol, [alpha]-monothioglycerol, and sodium thio sulfate; diluting agents; emulsifying agents; hydrophilic polymers such as polyvinylpyrrolidone); salt-forming counter-ions such as sodium; preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide); metal complexes such as Zn-protein complexes; solvents and co-solvents (such as glycerin, propylene glycol or polyethylene glycol); sugars and sugar alcohols, including polyols, trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols; suspending agents; surfactants or wetting agents such as pluronics, PEG, sorbitan esters, polysorbates such as polysorbate 20, polysorbate, triton, tromethamine, lecithin, cholesterol, tyloxapal; surfactants may be detergents, typically with a molecular weight of >1.2 KD and/or a polyether, typically with a molecular weight of >3 KD; non-limiting examples for detergents are Tween 20, Tween 40, Tween 60, Tween 80 and Tween 85; non-limiting examples for polyethers are PEG 3000, PEG 3350, PEG 4000 and PEG 5000; stability enhancing agents such as sucrose or sorbitol; tonicity enhancing agents such as alkali metal halides, typically sodium or potassium chloride, mannitol sorbitol; parenteral delivery vehicles including sodium chloride solution, Ringer's dextrose, dextrose and sodium chloride, lactated Ringer's, or fixed oils; intravenous delivery vehicles including fluid and nutrient replenishers, electrolyte replenishers (such as those based on Ringer's dextrose).

It is evident to those skilled in the art that the different excipients of the pharmaceutical composition (e.g., those listed above) can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

Polyols are useful stabilizing agents in both liquid and lyophilized formulations to protect proteins from physical and chemical degradation processes, and are also useful for adjusting the tonicity of formulations. Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Mannitol is commonly used to ensure structural stability of the cake in lyophilized formulations. It ensures structural stability to the cake. It is generally used with a lyoprotectant, e.g., sucrose. Sorbitol and sucrose are commonly used agents for adjusting tonicity and as stabilizers to protect against freeze-thaw stresses during transport or the preparation of bulks during the manufacturing process. PEG is useful to stabilize proteins and as a cryoprotectant.

Surfactants routinely are used to prevent, minimize, or reduce surface adsorption. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Commonly used surfactants include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration.

Antioxidants can—to some extent—prevent deleterious oxidation of proteins in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations are typically water-soluble and maintain their activity throughout the shelf life of a product. EDTA is a useful example.

Metal ions can act as protein co-factors and enable the formation of protein coordination complexes. Metal ions also can inhibit some processes that degrade proteins. However, metal ions also catalyze physical and chemical processes that degrade proteins.

Preservatives have the primary function to inhibit microbial growth and ensure product sterility throughout the shelf-life or term of use of the drug product, and are in particular needed for multi-dose formulations. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

Salts may be used in accordance with the disclosure to, for example, adjust the ionic strength and/or the isotonicity of the pharmaceutical formulation and/or to further improve the solubility and/or physical stability of the antibody construct or other ingredient. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility. Ionic species differ in their effects on proteins. A number of categorical rankings of ions and their effects on proteins have been developed that can be used in formulating pharmaceutical compositions in accordance with the disclosure. One example is the Hofmeister series, which ranks ionic and polar non-ionic solutes by their effect on the conformational stability of proteins in solution. Stabilizing solutes are referred to as "kosmotropic." Destabilizing solutes are referred to as "chaotropic." Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the pharmaceutical composition as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Particularly useful excipients for formulating the pharmaceutical composition include sucrose, trehalose, mannitol, sorbitol, arginine, lysine, polysorbate 20, polysorbate 80, poloxamer 188, pluronic and combinations thereof. Said excipients may be present in the pharmaceutical composition in different concentrations, as long as the composition exhibits the desirable properties as exemplified herein, and in particular promotes stabilization of the contained bispecific single chain antibody constructs. For instance, sucrose may be present in the pharmaceutical composition in a concentration between 2% (w/v) and 12% (w/v), i.e., in a concentration of 12% (w/v), 11% (w/v), 10% (w/v), 9% (w/v), 8% (w/v), 7% (w/v), 6% (w/v), 5% (w/v), 4% (w/v), 3% (w/v) or 2% (w/v). Typical sucrose concentrations range between 4% (w/v) and 10% (w/v) and more typically between 6% (w/v) and 10% (w/v). Polysorbate 80 may be present in the pharmaceutical composition in a concentration between 0.001% (w/v) and 0.5% (w/v), i.e., in a concentration of 0.5% (w/v), 0.2% (w/v), 0.1% (w/v), 0.08% (w/v), 0.05% (w/v), 0.02% (w/v), 0.01% (w/v), 0.008% (w/v), 0.005% (w/v), 0.002% (w/v) or 0.001% (w/v). Typical Polysorbate 80 concentrations range between 0.002% (w/v) and 0.5% (w/v), and typically between 0.005% (w/v) and 0.02% (w/v).

The pharmaceutical composition provided herein may in particular comprise one or more preservatives.

Useful preservatives for formulating pharmaceutical compositions generally include antimicrobials (e.g. anti-bacterial or anti-fungal agents), anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide). Antimicrobial preservatives are substances which are used to extend the shelf-life of medicines by reducing microbial proliferation. Preservatives that particularly useful for formulating the pharmaceutical composition of the disclosure include benzyl alcohol, chlorobutanol, phenol, meta-cresol, methylparaben, phenoxyethanol, propylparaben thiomerosal. The structure and typical concentration for the use of these preservatives are described in Table 1 of Meyer et al. J Pharm Sci. 96(12), 3155.

The aforementioned preservatives may be present in the pharmaceutical composition in different concentrations. For instance, benzyl alcohol may be present in a concentration ranging between 0.2 and 1.1% (v/v), chlorobutanol in a concentration ranging between 0.3-0.5% (v/v), phenol in a concentration ranging between 0.07 and 0.5% (v/v), meta-cresol in a concentration ranging between 0.17 and 0-32% (v/v) or thiomerosal in a concentration ranging between 0.003 to 0.01% (v/v). Typical concentrations for methylparaben are in the range of 0.05 and 0.5% (v/v), for phenoxyethanol in the range of 0.1 and 3% (v/v) and for propylparaben in the range of 0.05 and 0.5% (v/v).

However, it is also conceivable that the pharmaceutical composition does not comprise any preservatives. In particular, the disclosure inter alia provides a pharmaceutical composition being free of preservatives, comprising an IMA construct in a concentration of about 0.5 mg/ml, sulfobutylether-cyclodextrin sodium salt in a concentration of about 1% (w/v), and potassium phosphate in concentration of about 10 mM, and further sucrose in concentration of about 8% (w/v) of and polysorbate 80 in concentration of about 0.01% (w/v) at a pH of about 6.0.

In one aspect, the disclosure features a formulation that includes (a) an IMA molecule (e.g., a CD19 scFv or a CD3 scFv); (b) a lyoprotectant; (c) (optionally) a surfactant; (d) (optionally) a bulking agent; (e) (optionally) a tonicity adjusting agent; (0 (optionally) a stabilizer; (g) (optionally) a preservative, and (h) a buffer, such that the pH of the formulation is about 5.0 to 7.5. In some embodiments, the formulation is a liquid formulation, a lyophilized formulation, a reconstituted lyophilized formulation, an aerosol formulation, or a bulk storage formulation (e.g., frozen bulk storage formulation). In certain embodiments, the formulation is administered to a subject by injection (e.g., subcutaneous, intravascular, intramuscular or intraperitoneal) or by inhalation.

In certain embodiments, the IMA molecule in the formulation is at a concentration of about 0.5 mg/mL to about 350 mg/mL, about 0.5 mg/mL to about 300 mg/mL, about 0.5 mg/mL to about 250 mg/mL, about 0.5 mg/mL to about 150 mg/mL, about 1 mg/ml to about 130 mg/mL, about 10 mg/ml to about 130 mg/mL, about 50 mg/ml to about 120 mg/mL, about 80 mg/ml to about 120 mg/mL, about 88 mg/ml to about 100 mg/mL or about 10 mg/ml, about 25 mg/ml, about 50 mg/ml, about 80 mg/ml, about 100 mg/mL, about 130 mg/ml, about 150 mg/ml, about 200 mg/ml, about 250 mg/ml or about 300 mg/ml.

In other embodiments, the lyoprotectant of the formulation is a sugar, e.g., sucrose, sorbitol, or trehalose. For example, the lyoprotectant can be sucrose, sorbitol, or trehalose at a concentration about 2.5% to about 10%, about 5% to about 10%, about 5% to about 8%, or about 4%, about 4.5%, about 5%, about 5.5%, about 6%, about 6.5%, about 7%, about 7.5%, about 8%, about 8.5%, or about 9% (weight/volume).

In yet other embodiments, the buffer in the formulation is a histidine buffer at a concentration about 5 mM to about 50 mM. In other embodiments, the buffer in the formulation is a Tris buffer present at a concentration of less than about 5 mM to about 50 mM. The pH of the buffers of the formulation is generally between about 5 and 7. In some specific embodiments, the pH of the buffer of the formulation is about 5 to about 7.5, about 5.5 to about 7.2.

In some embodiments, the formulation (optionally) includes a surfactant at a concentration of about 0.001% to 0.6%. In some cases, the formulation contains greater than 0% and up to about 0.6% (e.g., about 0.1% to 0.2% of polysorbate-20, polysorbate-40, polysorbate-60, polysorbate-65, polysorbate-80 polysorbate-85, poloxamer-188, sorbitan monolaurate, sorbitan monopalmitate, sorbitan monostearate, sorbitan monooleate, sorbitan trilaurate, sorbitan tristearate, sorbitan trioleaste, or a combination thereof. Alternatively, the formulation can include poloxamer-188 at about 0.01% to 0.6%, about 0.1% to 0.6%, about 0.1% to 0.5%, about 0.1% to 0.4%, about 0.1% to 0.3%, or about 0.1% to 0.2%.

In certain embodiments, the formulation (optionally) includes a bulking agent, e.g., glycine, at a concentration from about 10 to about 200 mM, from about 25 to about 175 mM, from about 50 to about 150 mM, from about 75 to about 125 mM, or about 100 mM.

In other embodiments, the formulation (optionally) further includes a tonicity adjusting agent, e.g., a molecule that renders the formulation substantially isotonic or isoosmotic with human blood. Exemplary tonicity adjusting agents include sucrose, sorbitol, glycine, methionine, mannitol, dextrose, inositol, sodium chloride, arginine and arginine hydrochloride.

In yet other embodiments, the formulation (optionally) additionally includes a stabilizer, e.g., a molecule which, when combined with a protein of interest (e.g., the IMA molecule) substantially prevents or reduces chemical and/or physical instability of the protein of interest in lyophilized, liquid or storage form. Exemplary stabilizers include sucrose, sorbitol, glycine, inositol, sodium chloride, methionine, arginine, and arginine hydrochloride. In certain embodiments, the formulation includes a stabilizer in one or more of the following ranges: Sucrose from about 1% to about 12% (e.g., about 5%, about 7.5%, about 8% or about 10%); sorbitol from about 1% to about 7% (e.g., about 3%, about 4%, about 5%); inositol from about 1% to about 5%; glycine from about 10 mM to about 125 mM (e.g., about 25 mM to 100 mM, about 80 mM, about 90 mM, or about 100 mM); sodium chloride from about 10 mM to 150 mM (e.g., about 25 mM to 100 mM, about 55 mM); methionine from about 10 mM to about 100 mM (e.g., about 10 mM, about 20 mM, about 100 mM); arginine from about 10 mM to about 125 mM (e.g., about 25 mM to about 120 mM, or about 100 mM); arginine hydrochloride from about 10 mM to about 70 mM (e.g., about 10 mM to about 65 mM, or about 55 mM).

In other embodiments, the formulation may further include methionine, at a concentration from about 10 to about 200 mM, from about 25 to about 175 mM, from about 50 to about 150 mM, from about 75 to about 125 mM, or about 100 mM.

In one embodiment, a component of the formulation can function as one or more of a lyoprotectant, a tonicity adjusting agent and/or a stabilizer. For example, depending on the concentration of a component, e.g., sucrose, it can serve as one or more of a lyoprotectant, a tonicity adjusting agent and/or a stabilizer. In other embodiments where several of the components are required in a formulation, different components are used. For example, where the formulation requires a lyoprotectant, a tonicity adjusting agent and a stabilizer, different components are used (e.g., sucrose, glycine and inositol can be used in combination resulting in a combination of a lyoprotectant, a tonicity adjusting agent and a stabilizer, respectively).

In one embodiment, the formulation includes (a) an IMA molecule (e.g., a CD19 scF or a CD20 scFv or a CD3 scFv) or a C5 inhibitor (e.g. ecolizumab) at a concentration of about 0.5 to about 300 mg/mL, e.g., at about 1 mg/mL, about 10 mg/mL, about 25 mg/mL, about 50 mg/mL, about 80 mg/mL, about 88 mg/mL, about 100 mg/mL, about 118 mg/mL, about 130 mg/mL, about 150 mg/mL, or about 250 mg/mL; (b) sucrose at a concentration of about 5% to about 10%, e.g., about 5%, about 6%, about 6.5%, about 7%, about 7.5%, about 8%, about 10%; (c) polysorbate-80 at a concentration of about 0 to about 0.6%, e.g., 0.01%, 0.02%, 0.05%, 0.1%, 0.2%, 0.3%, 0.4%, 0.5%, or 0.6%; (d) (optionally) glycine at a concentration of about 0 to about 100 mM, e.g., 100 mM; (e) (optionally) methionine at a concentration of about 0 to about 100 mM, e.g., 100 mM; and (f) a histidine buffer (at a concentration about 10 mM to about 20 mM) or a Tris buffer (at a concentration about 20 mM), such that the pH of the formulation is about 5.0 to 7.5, e.g., 5, 5.5, 5.8-6.1, 6, 6.1, 6.5, or 7.

In one embodiment, the formulation is a liquid formulation. In one representative embodiment, the liquid formulation includes a) an IMA molecule (e.g., a CD19 scF or a CD20 scFv or a CD3 scFv) or a C5 inhibitor (e.g. ecolizumab) at a concentration of about 10 to about 150 mg/mL, e.g., about 25 mg/mL, about 50 mg/mL, about 80 mg/mL, about 88 mg/mL, about 100 mg/mL, about 118 mg/mL, about 130 mg/mL; (b) sucrose at a concentration of about 5% to about 10%. e.g., about 7% to about 8%, e.g., 7.5%; or sorbitol from about 1% to about 7% (e.g., about 3%, about 4%, about 5%) (c) polysorbate-80 at a concentration of about, e.g., about 0.01% to 0.02% (e.g., 0.01%); (d) (optionally) glycine at a concentration of about 0 to about 100 mM, e.g., 100 mM; (e) (optionally) methionine at a concentration of about 0 to about 100 mM, e.g., 100 mM; and (f) a histidine buffer (at a concentration about 10 mM to about 20 mM), or a Tris buffer (at a concentration about 20 mM), such that the pH of the formulation is about 5 to 7.5, e.g., 5, 5.5, 5.8-6.1, 6, 6.1, 6.5, or 7. The liquid formulation can be present in an article of manufacture, such as a device, a syringe or a vial with instructions for use. In certain embodiments, the syringe or a vial is composed of glass, plastic, or a polymeric material, such as cyclic olefin polymer or copolymer. In other embodiments, the formulation can be present in an injectable device (e.g., an injectable syringe, e.g., a prefilled injectable syringe). The syringe may be adapted for individual administration, e.g., as a single vial system including an autoinjector (e.g., a pen-injector device), and/or instructions for use. The formulation can be administered to a subject, e.g., a patient, by in injection, e.g., peripheral administration (e.g., subcutaneous, intravascular, intramuscular or intraperitoneal administration).

In other embodiments, the formulation is a lyophilized formulation. In one representative embodiment, the lyophilized formulation includes a) an IMA molecule (e.g., a CD19 scF or a CD20 scFv or a CD3 scFv) or a C5 inhibitor (e.g. ecolizumab) at a concentration of about 10 to about 150 mg/mL, e.g., about 25 mg/mL, about 50 mg/mL, about 80 mg/mL, about 88 mg/mL, about 100 mg/mL, about 118 mg/mL, about 130 mg/mL; (b) sucrose at a concentration of about 5% to about 10%, e.g, about 4% to about 7%, e.g., 5%; (c) polysorbate-80 at a concentration of about, e.g., 0.01% to 0.02% (e.g., 0.01%); (d) (optionally) glycine at a concentration of about 0 to about 100 mM. e.g., 100 mM; (e) (optionally) methionine at a concentration of about 0 to about 100 mM, e.g., 100 mM; and (f) a histidine buffer (at a concentration about 10 mM to about 20 mM, e.g., about 20 mM), or a Tris buffer (at a concentration about 20 mM), such that the pH of the formulation is about 5 to 7.5, e.g., 5, 5.5, 5.8-6.1, 6, 6.1, 6.5 or 7. The lyophilized formulation can be reconstituted by mixing the lyophilate with a suitable aqueous composition.

In yet other embodiments, the formulation is a bulk storage formulation. In one representative embodiment, the bulk storage formulation includes a) an IMA molecule (e.g., a CD19 scF or a CD20 scFv or a CD3 scFv) or a C5 inhibitor (e.g. ecolizumab) at a concentration of about 80 mg/mL to 300 mg/ml, e.g., about 150 mg/mL, about 175 mg/mL, about 200 mg/mL, about 250 mg/mL, about 275 mg/mL, or about 300 mg/mL; (b) sucrose at a concentration of about 5% to about 10%, e.g, about 4% to about 8%, e.g., 5%, or 7.5%; (c) polysorbate-80 at a concentration of about, e.g., 0.01% to 0.02%; (d) (optionally) glycine at a concentration of about 0 to about 100 mM, e.g., 100 mM; (e) (optionally) methionine at a concentration of about 0 to about 100 mM, e.g., 100 mM; and (f) a histidine buffer (at a concentration about 10 mM to about 20 mM) or a Tris buffer (at a concentration about 20 mM), such that the pH of the formulation is about 5 to 7.5, e.g., 5, 5.5, 5.8-6.1, 6, 6.1, 6.5 or 7. The bulk storage formulation can be frozen. In certain embodiments, the bulk storage formulation can be prepared in large scale, e.g., greater than 10 liters, 50 liters, 100, 150, 200 or more liters.

Protein aggregation represents a major event of physical instability of proteins and occurs due to the inherent tendency to minimize the thermodynamically unfavorable interaction between the solvent and hydrophobic protein residues. A β-cyclodextrin may be added to the formulation to prevent protein aggregation. The β-cyclodextrin may be present in a selected from the group consisting of β-cyclodextrin, methyl-β-cyclodextrin, hydroxyethyl-β-cyclodextrin, hydroxypropyl-β-cyclodextrin, ethyl-β-cyclodextrin, butyl-β-cyclodextrin Succinyl-(2-hydroxypropyl)^-cyclodextrin, heptakis(2,3,6-tri-O-methyl)-β-cyclodextrin, heptakis(2,3,6-tri-O-benzoyl)-β-cyclodextrin, β-cyclodextrin phosphate sodium salt, β-cyclodextrin sulphate sodium salt, triacetyl-β-cyclodextrin, heptakis(6-O-sulfo)-β-cyclodextrin heptasodium salt, carboxymethyl-β-cyclodextrin sodium salt, sulfobutylether-β-cyclodextrin sodium salt, 6-O-p-toluenesulfonyl-β-cyclodextrin, and in particular from sulfobutylether-β-cyclodextrin sodium salt, hydroxypropyl-β-cyclodextrin. It may be present in a concentration in the range of 0.1% to 20% (w/v), typically of 0.5% to 2% (w/v) and more commonly of 0.8% to 1.5% (w/v).

The composition may comprise one or more preservatives, particularly benzyl alcohol, chlorobutanol, phenol, meta-cresol, methylparaben, phenoxyethanol, propylparaben thiomerosal. The structure and typical concentration for the use of these preservatives are described in Table 1 of Meyer et al. J Pharm Sci. 96(12), 3155.

Also provided herein is a pharmaceutical composition free of preservatives, comprising an IMA and being in a concentration of about 0.5 mg/ml, and further a cyclodextrin being sulfobutylether-β-cyclodextrin sodium salt in a concentration of about 1% (w/v), and further a buffer being potassium phosphate in concentration of about 10 mM, said formulation further comprising sucrose in concentration of about 8% (w/v) of and polysorbate 80 in concentration of about 0.01% (w/v) at a pH of about 6.0.

[The pharmaceutical compositions of the disclosure can be formulated in various forms, e.g. in solid, liquid, frozen, gaseous or lyophilized form and may be, inter alia, in the form of an ointment, a cream, transdermal patches, a gel, powder, a tablet, solution, an aerosol, granules, pills, suspensions, emulsions, capsules, syrups, liquids, elixirs, extracts, tincture or fluid extracts.

Generally, various storage and/or dosage forms are conceivable for the pharmaceutical composition of the disclosure, depending, i.a., on the intended route of administration, delivery format and desired dosage (see, for example, Remington's Pharmaceutical Sciences, 22nd edition, Oslo, A., Ed., (2012)). The skilled person will be aware that such choice of a particular dosage form may for example influence the physical state, stability, rate of in vivo release and rate of in vivo clearance of the antibody construct of the disclosure.

For instance, the primary vehicle or carrier in a pharmaceutical composition may be either aqueous or non-aqueous in nature. A suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles.

When parenteral administration is contemplated, the therapeutic compositions of the disclosure may be provided in the form of a pyrogen-free, parenterally acceptable aqueous solution comprising the desired antibody construct in a pharmaceutically acceptable vehicle. A particularly suitable vehicle for parenteral injection is sterile distilled water in which the antibody construct is formulated as a sterile, isotonic solution, properly preserved. The preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. Hyaluronic acid may also be used, having the effect of promoting sustained duration in the circulation. Implantable drug delivery devices may be used to introduce the desired antibody construct.

Sustained- or controlled-delivery/release formulations are also envisaged herein. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949. The antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 22nd edition, Oslo, A., Ed., (2012).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

The antibody constructs disclosed herein may also be formulated as immuno-liposomes. A "liposome" is a small vesicle composed of various types of lipids, phospholipids and/or surfactant which is useful for delivery of a drug to a mammal.

It is envisaged that the composition of the disclosure might comprise, in addition to the IMA construct defined herein, further biologically active agents, depending on the intended use of the composition. Such agents might be in particular drugs acting on tumors and/or malignant cells, but other active agents are also conceivable depending on the intended use of the pharmaceutical composition, including agents acting on on the gastrointestinal system, drugs inhibiting immunoreactions (e.g. corticosteroids), drugs modulating the inflammatory response, drugs acting on the circulatory system and/or agents such as cytokines known in the art. It is also envisaged that the pharmaceutical composition of the disclosure is applied in a co-therapy, i.e., in combination with another anti-cancer medicament.

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. E.g., lyophilized compositions may be reconstituted in, e.g., bacteriostatic water for injection (BWFI), physiological saline, phosphate buffered saline (PBS), or the same formulation the protein had been in prior to lyophilization.

The pharmaceutical composition of the disclosure may in general be formulated for delivery by any suitable route of administration. In the context of the disclosure, the routes of administration include, but are not limited totopical routes (such as epicutaneous, inhalational, nasal, opthalmic, auricular/aural, vaginal, mucosal); enteral routes (such as oral, gastrointestinal, sublingual, sublabial, buccal, rectal); and parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions described herein are particularly useful for parenteral administration, e.g., subcutaneous or intravenous delivery, for example by injection such as bolus injection, or by infusion such as continuous infusion. Pharmaceutical compositions may be administered using a medical device.

The pharmaceutical composition of the disclosure can also be administered uninterruptedly. As a non-limiting example, uninterrupted or substantially uninterrupted, i.e., continuous administration may be realized by a small pump system worn by the patient for metering the influx of the antibody construct into the body of the patient. The pharmaceutical composition can be administered by using said pump systems.

The continuous or uninterrupted administration of the pharmaceutical composition of the disclosure may be intravenous or subcutaneous by way of a fluid delivery device or small pump system including a fluid driving mechanism for driving fluid out of a reservoir and an actuating mechanism for actuating the driving mechanism.

Continuous administration may also be achieved transdermally by way of a patch worn on the skin and replaced at intervals.

The skilled person will readily understand that the pharmaceutical composition of the disclosure may in general comprise any of the aforementioned excipients, or additional active agents, or may be provided in any suitable form as long as it is stable and typically exhibits the same advantageous properties as the pharmaceutical compositions provided in the examples. The skilled person will readily be able to adjust the various components so as to provide a pharmaceutical composition that is stable, i.e., is typically substantially free from aggregates and/or conformers of the IMA comprised within.

The administration of therapeutic compositions in accordance with the disclosure will be administered via a suitable route including, but not limited to, intravenously, subcutaneously, intramuscularly, intranasally, with suitable carriers, excipients, and other agents that are incorporated into formulations to provide improved transfer, delivery, tolerance, and the like.

These formulations include, for example, powders, pastes, ointments, jellies, waxes, oils, lipids, lipid (cationic or anionic) containing vesicles (such as LIPOFECTIN™), DNA conjugates, anhydrous absorption pastes, oil-in-water and water-in-oil emulsions, emulsions carbowax (polyethylene glycols of various molecular weights), semi-solid gels, and semisolid mixtures containing carbowax. See also Powell et al. "Compendium of excipients for parenteral formulations" PDA (1998) J Pharm Sci Technol 52:238-311.

The dose of pharmaceutical compositions (e.g., IMA or C5 inhibitor) of the disclosure may vary depending upon the age and the size of a patient to be administered, target disease, conditions, route of administration, and the like. When the IMA of the disclosure is used for treating CRS, it is advantageous to intravenously administer the IMA of the disclosure normally at a single dose of about 0.005 to about 30 mg/kg body weight, more commonly about 0.02 to about 7, about 0.03 to about 5, or about 0.05 to about 3 mg/kg body weight. Depending on the severity of the condition, the frequency and the duration of the treatment can be adjusted. In certain embodiments, the IMA of the disclosure can be administered as an initial dose of at least about 0.1 mg to about 800 mg, about 1 to about 500 mg, about 5 to about 300 mg, or about 10 to about 200 mg, to about 100 mg, or to about 50 mg. In certain embodiments, the initial dose may be followed by administration of a second or a plurality of subsequent doses of the IMA and/or C5 inhibitor in an amount that can be approximately the same or less than that of the initial dose, wherein the subsequent doses are separated by at least 1 h to 2 h, 2 h to 4 h, 4 h to 12 h, 12 h to 24 h, 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous and intramuscular injections, drip infusions, etc. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, FICO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is typically filled in an appropriate ampoule.

A pharmaceutical composition of the disclosure can be delivered subcutaneously or intravenously with a standard needle and syringe. In addition, with respect to subcutaneous delivery, a pen delivery device readily has applications in delivering a pharmaceutical composition of the disclosure. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition.

The pen delivery device can then be reused. In a disposable pen delivery device, there is no replaceable cartridge. Rather, the disposable pen delivery device comes prefilled with the pharmaceutical composition held in a reservoir within the device.

Once the reservoir is emptied of the pharmaceutical composition, the entire device is discarded.

Numerous reusable pen and autoinjector delivery devices have applications in the subcutaneous delivery of a pharmaceutical composition of the disclosure. Examples include, but certainly are not limited to AUTOPEN™ (Owen Mumford, Inc., Woodstock, UK), DISETRONIC™ pen (Disetronic Medical Systems, Burghdorf, Switzerland), HUMALOG 75/25™ pen, HUMALOG™ pen, HUMALIN 70/30™ pen (Eli Lilly and Co., Indianapolis, IN), NOVOPEN™ I, II and III (Novo Nordisk, Copenhagen, Denmark), NOVOPEN JUNIOR™ (Novo Nordisk. Copenhagen, Denmark), BD™ pen (Becton Dickinson, Franklin Lakes, NJ), OPTIPEN™, OPTIPEN PRO™, OPTIPEN STARLET™, and OPTICLIK™ (sanofi-aventis, Frankfurt, Germany), to name only a few. Examples of disposable pen delivery devices having applications in subcutaneous delivery of a pharmaceutical composition of the disclosure include, but certainly are not limited to the SOLOSTAR™ pen (sanofi-aventis), the FLEXPEN™ (Novo Nordisk), and the KWIKPEN™ (Eli Lilly), the SURECLICK™ Autoinjector (Amgen, Thousand Oaks, CA), the PENLET™ (Haselmeier, Stuttgart, Germany), the EPIPEN (Dey, L.P.) and the HUMIRA™ Pen (Abbott Labs, Abbott Park, IL), to name only a few. Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 1 to about 500 mg per dosage form in a unit dose; especially in the form of injection, it is typical that the aforesaid IMA is contained in about 1 to about 50 mg, in about 5 to about 100 mg and in about 10 to about 250 mg for the other dosage forms.

The disclosure also provides a method comprising administering a AMR molecule and/or a CAR and/or an accessory module (e.g., PDL1, PDL2, crmA, p35 etc), a cell expressing an AMR and/or a CAR and/or an accessory module (e.g., PDL1, PDL2, crmA, p35 etc) molecule or a cell comprising a nucleic acid encoding an AMR molecule and/or a CAR and/or an accessory module (e.g., PDL1, PDL2, crmA, p35 etc) to a subject. In one embodiment, the subject has a disorder described herein, e.g., the subject has cancer, infectious disease, allergic disease, degenerative disease or autoimmune disease, which expresses a target antigen described herein. In yet one embodiment, the subject has increased risk of a disorder described herein, e.g., the subject has increased risk of cancer, infectious disease, allergic disease, degenerative disease or autoimmune disease, which expresses a target antigen described herein. In one embodiment, the subject is a human. In another embodiment, the subject is an animal. In yet another embodiment, the subject is a companion animal such as a dog.

The disclosure provides methods for treating or preventing a disease associated with expression of a disease associated antigen described herein.

In one embodiment, the disclosure provides methods of treating or preventing a disease by providing to the subject in need thereof immune effector cells (e.g., T cells) or stem cells that can give rise to immune effector cells that are engineered to express an targeted X-CAR, wherein X represents a disease associated antigen as described herein and CAR represents a conventional CAR (e.g., a second generation CAR or a next generation CAR (e.g., SIR, Ab-TCR, TFP, TRI-TAC etc.), and wherein the disease causing or disease-associated cells express said X antigen. Table 15 provides a list of different antigens and the exemplary diseases that can be prevented, inhibited or treated using immune effector cells expressing CAR targeting these antigens.

In another embodiment, the disclosure provides methods of treating or preventing cancer by providing to the subject in need thereof immune effector cells (e.g., T cells) that are engineered to express a XCAR (or X-CAR) described herein, wherein the cancer cells express antigen target "X". In one embodiment, X is expressed on both normal cells and cancers cells, but is expressed at lower levels on normal cells. In another embodiment, the immune cells are allogeneic and are engineered to express one or more AMRs capable of binding to and/or interfering with one or more of endogenous proteins selected from the group consisting of TCR α chain, TCR β chain, TCRγ, TCRδ, CD3ε, CD3δ, CD3ζ, CD3γ, beta-2 microglobulin, a HLA molecule, CTLA-4, PD1, FAS, TRAIL-R1 (DR4), TRAIL-R2 (DR5), and CD52. In another embodiment, the immune cells are allogeneic and are engineered to express one or more accessory modules comprising PDL1, PDL2, MC159, crmA, p35 or an inhibitor of death receptor induced apoptosis. In an embodiment, the method further involves administration of genetically modified hematopoietic stem cells or progenitor cells expressing an AMR capable of protecting the hematopoietic stem cells or progenitor cells from the cytotoxicity of immune cells. In an embodiment, the method further involves administration of an antibody, an antibody fragment, scFv or non-immunoglobulin antigen binding domain to prevent and treat complications of adoptive cellular therapies.

In another aspect, a method of treating a subject, e.g., reducing or ameliorating a hyperproliferative disorder or condition (e.g., a cancer), e.g., solid tumor, a soft tissue tumor, a blood cancer, or a metastatic lesion, in a subject is provided. As used herein, the term "cancer" is meant to include all types of cancerous growths or oncogenic processes, metastatic tissues or malignantly transformed cells, tissues, or organs, irrespective of histopathologic type or stage of invasiveness. Exemplary solid tumors include malignancies, e.g., adenocarcinomas, sarcomas, and carcinomas, of the various organ systems, such as those affecting breast, liver, lung, brain, lymphoid, gastrointestinal (e.g., colon), genitourinary tract (e.g., renal, urothelial cells), prostate and pharynx. Adenocarcinomas include cancers such as most colon cancers, rectal cancer, renal-cell carcinoma, liver cancer, non-small cell carcinoma of the lung, cancer of the small intestine and cancer of the esophagus. In one embodiment, the cancer is a melanoma, e.g., an advanced stage melanoma. Metastatic lesions of the aforementioned cancers can also be treated or prevented using the methods and compositions of the disclosure. Examples of other cancers that can be treated or prevented include pancreatic cancer, bone cancer, skin cancer, cutaneous or intraocular malignant melanoma, uterine cancer, ovarian cancer, rectal cancer, cancer of the head or neck, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin Disease, non-Hodgkin lymphoma, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, chronic or acute leukemias including acute myeloid leukemia, chronic myeloid leukemia, acute lymphoblastic leukemia, chronic lymphocytic leukemia, solid tumors of childhood, lymphocytic lymphoma, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers including those induced by asbestos, and combinations of said cancers. Treatment of metastatic cancers, e.g., metastatic cancers that express PDL1 (Iwai et al. (2005) Int. Immunol. 17:133-144) can be effected using the antibody molecules described herein.

Exemplary cancers whose growth can be inhibited include cancers typically responsive to immunotherapy.

In one aspect, the disclosure provides genetically modified cells (e.g., AMR or CAR or TCR expressing immune cell and/or hematopoietic stem cells or progenitor cells) of the disclosure for use in treating or preventing cancer expressing a cancer associate antigen as described herein. In one aspect, genetically modified cells of the disclosure are capable of contacting a tumor cell with at least one cancer associated antigen expressed on its surface such that the genetically modified cells target the cancer cell and growth of the cancer is inhibited. In one aspect, the disclosure provides a genetically modified cell (e.g., a recombinant immune effector cell) for use in treating or preventing a disease expressing a disease associate antigen as described herein. In one aspect, genetically modified cell of the disclosure is capable of contacting a disease causing or a disease associated cell with at least one disease associated antigen expressed on its surface such that the genetically modified cell targets the disease causing or disease associated cell and growth of the disease is inhibited.

In one embodiment, the disclosure pertains to a method of inhibiting growth of a disease (e.g., cancer, autoimmune disease, infectious disease or allergic disease or a degenerative disease), comprising contacting the disease causing or disease associated cell with a genetically modified cell of the disclosure such that the immune receptor signaling (e.g., CAR-signaling) is activated in response to the antigen and targets the disease causing or disease associated cell, wherein the growth of the disease causing or disease associated cell is inhibited. In one aspect, the disclosure pertains to a method of preventing a disease, comprising administering to a patient at risk of disease a genetically modified cell of the disclosure such that the immune receptor signaling (e.g., CAR signaling or SIR signaling) is activated in response to the antigen and targets the disease causing or disease associated cell, wherein the growth of the disease causing or disease associated cell is prevented. In one aspect the disease is a cancer, an infectious disease, an immune disease, an allergic disease, or a degenerative disease.

In another embodiment, the disclosure pertains to a method of treating cancer in a subject. The method comprises administering to the subject genetically modified cell of the disclosure such that the cancer is treated in the subject. In one aspect, the cancer associated with expression of a cancer associate antigen as described herein is a blood or hematological cancer. In one aspect, the hematological cancer is leukemia or lymphoma. In one aspect, a cancer associated with expression of a cancer associate antigen as described herein includes cancers and malignancies including, but not limited to, e.g., one or more acute leukemias including but not limited to, e.g., B-cell acute Lymphoid Leukemia ("BALL"), pre-B cells Acute Lymphocytic Leukemia, T-cell acute Lymphoid Leukemia ("TALL"), acute lymphoid leukemia (ALL); one or more chronic leukemias including but not limited to, e.g., chronic myelogenous leukemia (CML), Chronic Lymphoid Leukemia (CLL). Further a disease associated with a cancer associate antigen as described herein expression include, but not limited to, e.g., atypical and/or non-classical cancers, malignancies, precancerous conditions or proliferative diseases associated with expression of a cancer associate antigen as described herein.

In yet another embodiment, the disclosure pertains to a method of treating a disease in a subject. The method comprises administering to the subject genetically modified cell of the disclosure such that the disease is treated in the subject. In one aspect, the disease associated with expression of a disease associate antigen as described herein is an infectious disease. In one aspect the infectious disease is disease associated with infection by HIV1, HIV2, HTLV1, Epstein Barr virus (EBV), cytomegalovirus (CMV), adenovirus, adeno-associated virus, BK virus, Human Herpesvirus 6, Human Herpesvirus 8, influenza A virus, influenza B virus parainfluenza virus, avian flu virus, MERS and SARS coronaviruses, Crimean Congo Hemorrhagic fever virus, rhino virus, enterovirus, Dengue virus, West Nile virus, Ebola virus, Marburg virus, Lassa fever virus, zika virus, RSV, measles virus, mumps virus, rhino virus, varicella virus, herpes simplex virus 1 and 2, varicella zoster virus, HIV-1, HTLV1, Hepatitis virus, enterovirus, hepatitis B virus, Hepatitis C virus, Nipah and Rift valley fever viruses, Japanese encephalitis virus, *Mycobacterium tuberculosis*, atypical mycobacteria species, *Pneumocystis jirovecii*, toxoplasmosis, *rickettsia, nocardia, aspergillus, mucor*, or *Candida.*

In yet another embodiment, the disclosure pertains to a method of treating a disease in a subject. The method comprises administering to the subject genetically modified cell of the disclosure such that the disease is treated in the subject. In one aspect, the disease associated with expression of a disease associate antigen as described herein is an immune or allergic or generative disease. In one aspect the immune or degenerative disease is diabetes mellitus, multiple sclerosis, rheumatoid arthritis, pemphigus vulgaris, ankylosing spondylitis, Hoshimoto's thyroiditis, SLE, sarcoidosis, scleroderma, mixed connective tissue disease, graft versus host disease, peanut allergy, chronic spontaneous urticaria, food allergy, hay fever, seasonal allergy, pollen allergy, HLH (hemophagocytic lymphohistiocytosis), amyloidosis or Alzheimer's disease.

The disclosure includes a type of cellular therapy where immune effector cells (e.g., T cells or stem cells that give rise to T cells) are genetically modified to express one or more synthetic or artificial receptors (e.g., AMR, CAR, SIR, etc.) and the genetically modified immune cell or stem cell is infused to a recipient in need thereof. One or more of the infused cell is able to kill disease associated cells (e.g., tumor cells or virally infected cells) in the recipient. Unlike antibody therapies, genetically-modified immune effector cells (e.g., T cells, stem cells) are able to replicate in vivo resulting in long-term persistence that can lead to sustained tumor control. In various aspects, the immune effector cells (e.g., T cells or stem cells that can give rise to T cells) administered to the patient, or their progeny, persist in the patient for at least four months, five months, to upto ten years after administration of the T cell or stem cells to the patient.

The disclosure also includes a type of cellular therapy where immune effector cells (e.g., T cells) are genetically modified, e.g., by in vitro transcribed RNA, to transiently express a synthetic receptor (e.g., AMR, CAR, SIR, Ab-TCR, TFP etc.) the genetically modified cell is infused to a recipient in need thereof. The infused cell is able to kill disease associated cells (e.g., tumor cells or virally infected cells) in the recipient. Thus, in various aspects, the genetically modified cells (e.g., T cells) administered to the patient, is present for less than one month, e.g., three weeks, two weeks, one week, after administration of the T cell to the patient.

The disclosure also includes a type of cellular therapy where stem cells (e.g., hematopoietic stem cell or lymphoid stem cells or embryonic stem cells, or induced pluripotent stem cells) are genetically modified to express one or more synthetic receptors (e.g., AMR, CAR, SIR, Ab-TCR, TFP etc.) and are administered to a recipient in need thereof. The administered stem cells give rise to differentiated progeny cells, including immune effector cells (e.g., T cells) after transplantation into the recipient, which (i.e., the immune effector cells) are able to kill disease associated cells in the recipient. Thus, in various aspects, the immune effector cells (e.g., T cells) that are produced in the patient after administration of genetically modified stem cells, persist in the patient for at least one week, 2 weeks, 3 weeks, one month, two months, three months, one year, ten years or twenty years after administration of the T cell or stem cells to the patient. The disclosure also includes a type of cellular therapy where stem cells are genetically modified to express one or more synthetic receptors (e.g., AMR, CAR, SIR, Ab-TCR, TFP, TRI-TAC etc) and are differentiated in vitro to generate immune effector cells that are infused to a recipient in need thereof. The infused immune effector cells (e.g., T cells) after infusion into the recipient are able to kill disease associated cells in the recipient. Thus, in various aspects, the immune effector cells (e.g., T cells) that are administered to the patient persist in the patient for at least 1 day, 3 days, 4 days, 5 days, one week, one month, one year, two years, three years, four years, ten years or twenty years.

The disclosure also includes a type of cellular therapy where regulatory immune effector cells (e.g., TREG, or CD25+ T Cells) are modified to express one or more synthetic receptor (e.g., AMR, CAR, SIR, Ab-TCR etc.) targeting a specific antigen. Such genetically modified TREG are administered to a patient to suppress immune response against the specific antigen. The genetically modified-TREG can be used to prevent and treat autoimmune diseases and to enhance immune tolerance. Without wishing to be bound by any particular theory, the anti-tumor immunity response elicited by the genetically-modified immune effector cells (e.g., T cells) may be an active or a passive immune response, or alternatively may be due to a direct vs indirect immune response. In one aspect, the genetically modified immune effector cells (e.g., T cells) exhibit specific pro inflammatory cytokine secretion and potent cytolytic activity in response to human diseased cells (e.g., cancer or infected cells) expressing a disease associate antigen as described herein, resist soluble disease associate antigen as described herein, mediate bystander killing and mediate regression of an established human disease, including cancer. For example, antigen-less tumor cells within a heterogeneous field of a cancer associate antigen as described herein-expressing tumor may be susceptible to indirect destruction by a cancer associate antigen as described herein-redirected immune effector cells (e.g., T cells) that has previously reacted against adjacent antigen-positive cancer cells.

In one aspect, the genetically-modified immune effector cells (e.g., T cells) of the disclosure may be a type of vaccine for ex vivo immunization and/or in vivo therapy in a mammal. In one aspect, the mammal is a human. In one aspect, the mammal is a dog.

With respect to ex vivo immunization, at least one of the following occurs in vitro prior to administering the cell into a mammal: i) expansion of the cells, ii) introducing a nucleic acid encoding a SIR to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a vector expressing one or more synthetic receptors (e.g., AMR, CAR, SIR etc.) and/or accessory modules (e.g., PDL1, PDL2, crmA, p35, MC159) disclosed herein. The genetically-modified cell can be administered to a mammalian recipient to provide a therapeutic benefit. The mammalian recipient may be a human and the genetically-modified cell can be autologous with respect to the recipient. Alternatively, the genetically-modified cell can be allogeneic, syngeneic or xenogeneic with respect to the recipient.

In another embodiment, the genetically-modified cells are used ex vivo to purge the bone marrow or peripheral blood hematopoietic stem cells of disease-associated cells (e.g. cancer cells). As an example, T cells expressing CD19-SIR are co-cultured with bone marrow or peripheral blood stem cell sample taken from a patient with acute lymphocytic leukemia or non-Hodgkin lymphoma so as to kill off any leukemia or lymphoma cells present in the bone marrow or peripheral blood stem cell preparation. After a suitable duration of culture in vitro (ex vivo), which may range from a 6 hours to several days, the purged bone marrow and peripheral blood sample is used for autologous transplant in the patient.

The procedure for ex vivo expansion of hematopoietic stem and progenitor cells is described in U.S. Pat. No. 5,199,942, incorporated herein by reference, can be applied to the cells of the disclosure. Other suitable methods are known in the art. Therefore, the disclosure is not limited to any particular method of ex vivo expansion of the cells. Briefly, ex vivo culture and expansion of immune effector cells (e.g., T cells) comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the disclosure also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the genetically modified cells (e.g., T cells) of the disclosure are used in the treatment of diseases, disorders and conditions associated with expression of a disease associate antigen (e.g., cancer antigen or a viral antigen) as described herein. In certain aspects, the cells of the disclosure are used in the treatment of patients at risk for developing diseases, disorders and conditions associated with expression of a disease associate antigen as described herein. Thus, the disclosure provides methods for the treatment or prevention of diseases, disorders and conditions associated with expression of a disease associate antigen as described herein comprising administering to a subject in need thereof, a therapeutically effective amount of the genetically-modified cells (e.g., T cells) or stem cells that are capable of generating immune effector cells of the disclosure.

In one aspect the genetically modified cells of the disclosures may be used to treat a proliferative disease such as a cancer or malignancy or is a precancerous condition such as a myelodysplasia, a myelodysplastic syndrome or a pre-leukemia. Further a disease associated with a cancer associate antigen as described herein expression include, but not limited to, e.g., atypical and/or non-classical cancers, malignancies, precancerous conditions or proliferative diseases expressing a cancer associated antigen as described herein. Non-cancer related indications associated with expression of a disease associate antigen as described herein include, but are not limited to, e.g., autoimmune disease, (e.g., lupus), inflammatory disorders (allergy and asthma), infectious conditions (e.g., HIV1, CMV, EBV, influenza) and transplantation.

The genetically-modified immune effector cells (e.g., T cells) of the disclosure may be administered either alone, or as a pharmaceutical composition in combination with diluents and/or with other components such as IL-2 or other cytokines or cell populations.

The disclosure provides for compositions and methods for treating and preventing cancer. In one aspect, the cancer is a hematologic cancer or blood cancer including but is not limited to hematological cancer is a leukemia, pre-leukemia or a lymphoma. Further a disease associated with a cancer associate antigen as described herein expression includes, but not limited to, e.g., atypical and/or non-classical cancers, malignancies, precancerous conditions or proliferative diseases expressing a cancer associate antigen as described herein.

The disclosure also provides methods for inhibiting the proliferation or reducing a disease associated antigen as described herein-expressing cell population, the methods comprising contacting a population of cells comprising a disease associated antigen as described herein-expressing cell with a genetically modified cell of the disclosure that binds to a disease associate antigen as described herein-expressing cell. In a specific aspect, the disclosure provides methods for inhibiting the proliferation or reducing the population of diseased cells expressing a disease associated antigen as described herein, the methods comprising contacting a disease associate antigen as described herein expressing cancer cell population with a genetically modified cell of the disclosure that binds to a disease associated antigen as described herein-expressing cell. In one aspect, the disclosure provides methods for inhibiting the proliferation or reducing the population of diseased cells expressing a disease associated antigen as described herein, the methods comprising contacting a disease associated antigen as described herein-expressing diseased cell population with a genetically modified cell of the disclosure that binds to a diseased associated antigen as described herein-expressing cell. In certain aspects, a genetically modified cell of the disclosure reduces the quantity, number, amount or percentage of cells and/or diseased cells by at least 25%, at least 30%, at least 40%, at least 50%, at least 65%, at least 75%, at least 85%, at least 95%, or at least 99% in a subject with or animal model for myeloid leukemia or another disease associated with a disease associated antigen as described herein-expressing cells relative to a negative control. In one aspect, the subject is a human. In one aspect the disease is cancer, infectious disease, immune disease, allergy or degenerative disease.

The disclosure also provides methods for preventing, treating and/or managing a disease associated with a disease associated antigen as described herein expressing cells (e.g., a hematologic cancer or atypical cancer or infectious disease or immune disease or allergic disease or degenerative disease expressing a disease associated antigen as described herein), the methods comprising administering to a subject in need a genetically modified cell of the disclosure that binds to a disease associated antigen as described herein-expressing cell. In one aspect, the subject is a human. Non-limiting examples of disorders associated with a disease associated antigen as described herein expressing cells include autoimmune disorders (such as lupus), inflammatory disorders (such as allergies and asthma), infections (such as HIV1, HTLV1, Influenza, CMV, Adenovirus, EBV and HHV8) and cancers (such as hematological cancers or atypical cancers expressing a cancer associated antigen as described herein).

The disclosure also provides methods for preventing, treating and/or managing a disease associated with a disease associated antigen as described herein expressing cells, the methods comprising administering to a subject in need a genetically modified cell of the disclosure that binds to a disease associated antigen as described herein expressing cell. In one aspect, the subject is a human.

The disclosure provides methods for preventing relapse of disease associated with a disease associated antigen as described herein-expressing cells, the methods comprising administering to a subject in need thereof a genetically modified cell of the disclosure that binds to a disease associated antigen as described herein-expressing cell. In one aspect, the methods comprise administering to the subject in need thereof an effective amount of a genetically modified cell described herein that binds to a disease associated antigen as described herein-expressing cell in combination with an effective amount of another therapy.

The disclosure also provides a method of treating or preventing a disease in a subject having a disease or an increased risk of a disease associated with expression of a target antigen comprising administering to the subject an effective amount of one or more cell types comprising one or more synthetic receptor molecules (e.g., AMR, CAR, SIR, Ab-TCR etc.) and/or accessory modules (e.g., PDL1, PDL2, crmA, p35, MC159 etc.) of the disclosure.

The disclosure also provides a method of treating a subject or preventing a disease in a subject having a disease or an increased risk of a disease associated with expression of a target antigen, comprising administering to the subject an effective amount of a cell, e.g., a genetically modified cell, e.g., an immune effector cell (e.g., a population of immune effector cells) comprising a natural (e.g., TCR) and/or synthetic receptor (e.g., AMR, CAR, SIR, Ab-TCR etc.) and/or accessory modules (e.g., PDL1, PDL2, crmA, p35, MC159 etc.) of the disclosure.

The disclosure provides a method of administering to a subject an effective amount of a cell, e.g., a genetically modified cell, e.g., an immune effector cell (e.g., a population of immune effector cells) comprising a natural (e.g., TCR) and/or synthetic receptor (e.g., AMR, CAR, SIR, Ab-TCR etc.) and/or accessory modules (e.g., PDL1, PDL2, crmA, p35, MC159 etc.) of the disclosure, optionally in combination with an agent that increases the efficacy, in vivo persistence and/or safety of the genetically modified cell and reduce their rejection. In various embodiments, the agent that increases the efficacy and/or safety of the genetically modified cell is selected from the group consisting of (i) an antibody; (ii) an antibody fragment; (iii) an scFv; (iv) a non-immunoglobulin antigen binding domain; (v) a soluble receptor. In various embodiments, the agent is an immune modulating agent. In various embodiments, the agent is an agent that targets CD52. In various embodiments, the agent is an immune modulating agent (IMA) that interferes with the interaction between the immune effector cells (e.g., CAR-T cells or T cells exposed to bispecific/multispecific antibodies or NK cells exposed to NKp46-bispecific NK cell engagers etc.) and the target antigen (e.g., CD19, CD20 etc.) or the target antigen expressing cells (e.g., cancer cells).

In some embodiments, the disease to be treated or prevented is a hematologic cancer. In further embodiments, the hematologic cancer is leukemia. In another embodiment, the disease associated with a tumor antigen described herein is a solid tumor.

In some embodiments, the tumor antigen associated with the disease is selected from: CD5, CD19, CD123, CD22, CD23, CD30, CD171, CS-1, CLL-1 (CLECL1), CD33, EGFRviii, GD2, GD3, BCMA, Tn Ag, PSMA, ROR1, FLT3, TAG72, CD38, CD44v6, CEA, EPCAM, B7H3, KIT, IL-13Ra2, Mesothelin, IL-11Ra, PSCA, PRSS21, VEGFR2, LewisY, CD24, PDGFR-beta, SSEA-4, CD20, Folate receptor alpha, ERBB2 (Her2/neu), MUC1, EGFR, NCAM, Prostase, PAP, ELF2M, Ephrin B2, FAP, IGF-I receptor, CA1X, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, TSHR, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, legumain, HPV E6, E7, intestinal carboxyl esterase, mut hsp70-2, CD79a, CD79b, CD72, LAIR1, FCAR, LILRA2, CD300LF, CLEC12A, BST2, EMR2, LY75, FCRL5, IGLL1, MPL, FITC, Biotin, c-MYC epitope Tag, CD34, LAMP1, TROP2, GFRalpha4, CDH17, CDH6, NYBR1, CDH19, CD200R, Slea (CA19.9; Sialyl Lewis Antigen), PTK7, gpNMB, CDH1-CD324, DLL3, CD276/B7H3, IL11Ra, IL13Ra2, CD179b-IGLl1, ALK, TCRgamma-delta, NKG2D, CD32 (FCGR2A), Tn ag, CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, FITC, Leutenizing hormone receptor (LHR), CCR4, GD3, GLYPICAN-3 (GPC3), SLAMF6, SLAMF4, HTLV1-Tax, EBV-EBNA3c, HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, TISSUE FAACTOR 1 (TF1), AFP, GPRC5D, CLAUDIN18.2 (CLD18A2 OR CLDN18A.2)), P-GLYCOPROTEIN, STEAP1, LIV1, NECTIN-4, CRIPTO, GPA33, BST1/CD157, LOW CONDUCTANCE CHLORIDE CHANNEL, antigen recognized by TNT antibody, TSHR, CD 171, CS-1, CLL-1, GD3, Tn Ag, FLT3, CD38, CD44v6, a glycosylated CD43 epitope expersed on acute leukemia or lymphoma but not on hematopoietic progenitors, a glycosylated CD43 epitope expressed on non-hematopoietic cancers, B7H3, KIT, IL-13Ra2, IL-11Ra, PSCA, PRSS21, VEGFR2, LewisY, CD24, PDGFR-beta, SSEA-4, MUC1, EGFR, NCAM, CA1X, LMP2, EphA2, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRL5, IGLL1, TSHR, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, and OR51E2.

In some embodiments, the disease to be treated is an infectious disease including, but not limited to, infection by HIV1, HIV2, HTLV1, Epstein Barr virus (EBV), cytomegalovirus (CMV), adenovirus, adeno-associated virus, BK virus, Human Herpesvirus 6, Human Herpesvirus 8 influenza virus, parainfluenza virus, avian flu virus, MERS and SARS coronaviruses, Crimean Congo Hemorrhagic fever virus, rhino virus, enterovirus, Dengue virus, West Nile virus, Ebola virus, Marburg virus, Lassa fever virus, zika virus, RSV, measles virus, mumps virus, rhino virus, varicella virus, herpes simplex virus 1 and 2, varicella zoster virus, HIV-1, HTLV1, Hepatitis virus, enterovirus, hepatitis B virus, Hepatitis C virus, Nipah and Rift valley fever viruses, Japanese encephalitis virus, *Mycobacterium tuberculosis*, atypical mycobacteria species, *Pneumocystis jirovecii*, toxoplasmosis, *rickettsia, nocardia, aspergillus, mucor*, or *candida*. In such diseases, the the target antigen associated with the disease is selected from: HIV1 envelope glycoprotein, HIV1-gag, HTLV1-Tax, CMV pp65, EBV-EBNA3c, influenza A hemagglutinin (HA) and GAD.

The disease to be treated or prevented by the methods and compositions of the disclosure can be an immune or degenerative disease. In such embodiments, the target antigen associated with the disease is an autoantibody. Exemplary autoantibodies that are suitable targets for SIR/CAR are autoantibodies against Dsg3 or Dsg1.

In certain embodiments of the methods or uses described herein, the genetically modified cell (or cells) and/or IMA of the disclosure are administered in combination with an agent that increases the efficacy of the genetically modified cells, e.g., one or more of a protein phosphatase inhibitor, a kinase inhibitor, a cytokine, a chemokine, an antibody, an antibody fragment, a scFV fragment, a bispecific antibody, a non-immunoglobulin antigen binding domain, a soluble receptor, an inhibitor of an immune inhibitory molecule; a cellular signaling protein, a viral signaling protein, or an agent that decreases the level or activity of a TREG cell. In some embodiments, the agent that inhibits the immune inhibitory molecule may be one or more of an antibody or antibody fragment, an inhibitory nucleic acid, a clustered regularly interspaced short palindromic repeats (CRISPR), a transcription-activator like effector nuclease (TALEN), or a zinc finger endonuclease (ZFN) that inhibits the expression of the inhibitory molecule. In other embodiments of the methods or uses described herein, the agent that decreases the level or activity of the TREG cells is chosen from cyclophosphamide, antiGITR antibody, CD25-depletion, or a combination thereof. In certain embodiments of the methods or uses described herein, the immune inhibitory molecule is selected from the group consisting of PD1, PD-L1, CTLA-4, TIM-3, LAG-3, VISTA, BTLA, TIGIT, LAIR1, CD160, 2B4, TGFR beta, CEACAM-1, CEACAM-3, and CEACAM-5. In other embodiments, cytokine is chosen from IL2, IL-7, IL-15 or IL-21, or both. In other embodiments, the genetically modified cells of the disclosure and a second, e.g., any of the combination therapies disclosed herein (e.g., the agent that that increases the efficacy of the immune effector cell) are administered substantially simultaneously or sequentially.

In one embodiment, lymphocyte infusion, for example allogeneic lymphocyte infusion, is used in the treatment of the cancer, infectious or immune diseases, wherein the lymphocyte infusion comprises at least one genetically modified cell of the disclosure. In one embodiment, autologous lymphocyte infusion is used in the treatment of the cancer, infectious or immune diseases, wherein the autologous lymphocyte infusion comprises at least one genetically modified cell described herein.

In one embodiment, the method includes administering a cell expressing the genetically modified cells, as described herein, in combination with an agent which enhances the activity of a genetically modified cell, wherein the agent is a cytokine, e.g., IL-2, IL-7, IL-15, IL-21, or a combination thereof. The cytokine can be delivered in combination with, e.g., simultaneously or shortly after, administration of the genetically modified cell. Alternatively, the cytokine can be delivered after a prolonged period of time after administration of the genetically modified cell, e.g., after assessment of the subject's response to the genetically modified cell. In one embodiment the cytokine is administered to the subject simultaneously (e.g., administered on the same day) with or shortly after administration (e.g., administered 1 day, 2 days, 3 days, 4 days, 5 days, 6 days, or 7 days after administration) of the genetically modified cell or population of cells. In other embodiments, the cytokine is administered to the subject after a prolonged period of time (e.g., at least 2 weeks, 3 weeks, 4 weeks, 6 weeks, 8 weeks, 10 weeks, or more) after administration of the genetically modified cell or population of cells, or after assessment of the subject's response to the genetically modified cell or population of cells.

In other embodiments, the genetically modified cell or population of cells are administered in combination with an agent that ameliorates one or more side effects associated with administration of the genetically modified cell or population of cells. Side effects associated with the genetically modified cell or population of cells cell can be chosen from cytokine release syndrome (CRS), hemophagocytic lymphohistiocytosis (HLH) or neurological complications (CRES). Examples of such agents include steroids (e.g. prednisone, dexamethasone), IL6R antagonists (e.g., tocilizumab), src kinase inhibitors (e.g., dasatinib), a kinase inhibitor (e.g., Ibrutinib), calcineurin inhibitors (e.g., tacrolimus or cyclosporine A) or chemotherapy drugs (e.g., cyclophosphamide, methotrexate or vincristine).

In embodiments of any of the aforesaid methods or uses, the genetically modified cell or population of cells are administered in combination with an agent that treats the disease associated with expression of the target antigen, e.g., any of the second or third therapies disclosed herein. Additional exemplary combinations include one or more of the following.

In another embodiment, the genetically modified cell or population of cells, e.g., as described herein, can be administered in combination with another agent that increases the expression of the target antigen against which the genetically modified cell or population of cells is directed. For example, Classical Hodgkin's lymphoma, is characterized by the virtual lack of genes that are expressed in B-cells. Epigenetic repression of B-cell-specific genes via promoter hypermethylation and histone deacetylation and diminished expression of B-cell-committed transcription factors is reported to contribute to the lost B-cell phenotype in this disease. Du, J et al, identified several compounds (compounds 27, 40, 49) which promoted re-expression of the B-cell phenotype in classical Hodgkin lymphoma cells (Blood; Prepublished online Oct. 12, 2016). Anti-leukemia drugs arsenic trioxide and ATRA were also reported to promote re-expression of B cell phenotype in classical Hodgkin lymphoma when used alone or in combination with the identified compounds 27, 40 and 49. In one embodiment genetically modified cell or population of cells targeting B cell markers, such as CD19, CD20, CD22 etc, can be administered in combination with one or more of compounds 27, 40, 49, Arsenic trixoxide and ATRA.

In one embodiment, the genetically modified cell or population of cells of the disclosure, e.g., T cell, NK cell or hematopoietic stem cell, is administered to a subject that has received a previous stem cell transplantation, e.g., autologous stem cell transplantation or an allogenic stem cell transplanation.

In one embodiment, the genetically modified cell or population of cells of the disclosure, e.g., T cell, NK cells or hematopoietic stem cells, is administered to a subject that has received a previous dose of chemotherapy, such as melphalan, fludarabine or cylophosphamide.

In one embodiment, the genetically modified cell or population of cells is administered in combination with an agent that increases the efficacy of the cell.

In one embodiment, the genetically modified cell or population of cells are administered in combination with a low, immune enhancing dose of an mTOR inhibitor.

Animal models can also be used to measure activity of the genetically modified cell or population of cells of the disclosure. For example, xenograft model using human cancer associated antigen described herein-specific $CAR^+$ T cells to treat a primary human pre-B-ALL in immunodeficient mice can be used. See, e.g., Milone et al., Molecular Therapy 17(S): 1453-1464 (2009).

Assessment of cell proliferation and cytokine production has been previously described, e.g., at Milone et al., Molecular Therapy 17(S): 1453-1464 (2009). Alternatively, a non-radioactive luciferase based Matador Assay can be used.

Expression of the synthetic receptors (e.g., AMR, CAR, SIR, Ab-TCR, TFP etc.) on the surface of the target cells can be measured using luciferase based Topanga Assay or using flow cytometry.

Imaging technologies can be used to evaluate specific trafficking and proliferation of CARs in tumor-bearing animal models.

Pharmaceutical compositions of the disclosure may comprise a genetically modified cell or population of cells in combination with one or more IMA, as described herein, in combination with one or more pharmaceutically or physiologically acceptable carriers, diluents or excipients. The composition may further comprise a secondary active agent (e.g., an anticancer, antiviral or antibiotic agent).

Pharmaceutical compositions of the disclosure may be administered in a manner appropriate to the disease to be treated (or prevented). The quantity and frequency of administration will be determined by such factors as the condition of the patient, and the type and severity of the patient's disease. When "an immunologically effective amount," "an anti-tumor effective amount," "a tumor-inhibiting effective amount," or "therapeutic amount" or "anti-infective" is indicated, the amount of the compositions of the disclosure to be administered can be determined by a physician with consideration of individual differences in age, weight, tumor size, extent of infection or metastasis, and condition of the patient (subject) as the case may be. It can generally be stated that a pharmaceutical composition comprising the genetically modified cell or population of cells described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In certain aspects, it may be desired to administer genetically modified cell or population of cells (e.g., T cells, NK cells) to a subject and then subsequently redraw blood (or have an apheresis performed), activate genetically modified cell or population of cells (e.g., T cells, NK cells) therefrom according to the disclosure, and reinfuse the patient with these activated and expanded genetically modified cell or population of cells (e.g., T cells, NK cells). This process can be carried out multiple times every few weeks. In certain aspects, genetically modified cell or population of cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

In some embodiments, subjects may undergo leukapheresis, wherein leukocytes and peripheral blood stem cells are collected, enriched, or depleted ex vivo to select and/or isolate the cells of interest, e.g., T cells or CD34+ stem cells. These T cell or stem cell isolates may be expanded by methods known in the art and treated and/or transformed such that one or more synthetic receptor (e.g., AMR, CAR, SIR, Ab-TCR, TFP etc.) of the disclosure may be introduced, thereby creating genetically modified cell or population of cells of the disclosure. Subjects in need thereof may subsequently undergo standard treatment with high dose chemotherapy followed by peripheral blood stem cell transplantation. In certain aspects, following or concurrent with the transplant, subjects receive an infusion of the expanded genetically modified cell or population of cells of the disclosure. In an additional aspect, expanded cells are administered before or following surgery.

Kits to practice the disclosure are also provided. For example, kits for treating a cancer in a subject, or making a genetically modified cell or population of cells that expresses one or more of the synthetic receptors disclosed herein. The kits may include one or more nucleic acid molecules or a polypeptide molecules encoding one or more synthetic receptors or one or more vectors encoding one or more synthetic receptors along with a method to introduce the nucleic acid into the immune effector cells. The kit may include one or more viruses comprising one or more nucleic acid encoding one or more synthetic receptors and chemicals, such as polybrene, to enhance the virus transduction. The kit may contain one or more agents, (e.g., antibody) that prevent or reduce the accidental insertion of the CAR (e.g., CD19 CAR) into cancer cells. The kit may contain one or more agents (e.g., coelentrazine) to measure titer of lentiviral particles. The kit may contain components for isolation of T cells or stem cells for expressing a synthetic receptor. Alternatively, the kit may contain immune effector cells (e.g., T cells or NK cells) or stem cells expressing one or more synthetic receptor. More than one of the disclosed synthetic receptor can be included in the kit. The kit can include a container and a label or package insert on or associated with the container.

Suitable containers include, for example, bottles, vials, syringes, etc. The containers may be formed from a variety of materials such as glass or plastic. The container typically holds a composition including one or more of the nucleic acid molecules, viruses, vectors, immune cells or stem cells expressing a synthetic receptor. In several embodiments the container may have a sterile access port (for example the container may be an intravenous solution bag or a vial having a stopper pierceable by a hypodermic injection needle). A label or package insert indicates that the composition is used for treating the particular condition. The label or package insert typically will further include instructions for use of a disclosed nucleic acid molecules, synthetic receptors or immune cells/stem cells expressing synthetic receptors, for example, in a method of treating or preventing a tumor or of making a genetically modified cell or population of cells. The package insert typically includes instructions customarily included in commercial packages of therapeutic products that contain information about the indications, usage, dosage, administration, contraindications and/or warnings concerning the use of such therapeutic products. The instructional materials may be written, in an electronic form (such as a computer diskette or compact disk) or may be visual (such as video files). The kits may also include additional components to facilitate the particular application for which the kit is designed. Thus, for example, the kit may additionally contain means for measuring the expression of synthetic receptors on T cells or of determining the number or percentage of T cells that express the synthetic receptors or of determining the functionality of genetically modified cell or population of cells. The kits may additionally include buffers and other reagents routinely used for the practice of a particular method. Such kits and appropriate contents are well known to those of skill in the art.

EXAMPLES

Cell lines engineered to express luciferases (e.g., GLuc or NLuc) for measuring cytotoxicity of different constructs targeting different cell surface and intracellular antigens are provided in Table A. Cell lines used in this experiments, target antigens on the cells lines and their growth media are shown in the following Table A. Cells were cultured at 37° C., in a 5% $CO_2$ humidified incubator. The cell lines were obtained from ATCC, NIH AIDS reagent program or were available in the laboratory.

TABLE A

| Cell line | Culture Conditions | Exemplary CAR Target Antigens Expressed |
|---|---|---|
| BC-1 | RPMI, 20% FCS | BCMA, GPRC, CD138 |
| BC-3 | RPMI, 20% FCS | BCMA, GPRC, CD138 |
| BCBL-1 | RPMI, 20% FCS | GPRC, CD138 |
| JSC-1 | RPMI, 20% FCS | GPRC, CD138 |
| MM1S | RPMI, 10% FCS | CD38, GPRC, CD44, CD200R |
| U266 | RPMI, 10% FCS | BCMA, WT1/HLA-A2+, CS1, CLL1, CD138, c-MET, IL6R, CD179b, NY-ESO/HLA-A2, NYBR, LAMP1 |
| L363 | RPMI, 10% FCS | BCMA, GPRC, WT1/HLA-A2+, CS1, CLL1, CD138, NY-ESO/HLA-A2, NYBR, LAMP1 |
| K562 | RPMI, 10% FCS | CD33, IL1Ra, TnAg |
| BV173 | RPMI, 10% FCS | CD123, CD179b, IL1Ra, WT1/HLA-A2+, CXCR4, FLT3, CD179a |
| Nalm6 | RPMI, 10% FCS | CD19, CD20, CD22, CD179b, CD179a |
| HL60 | RPMI, 10% FCS | CD33, CD34, CLL1, IL6R, CD32, CD179 |
| U937 | RPMI, 10% FCS | CD4, CLL1 |
| RS:411 | RPMI, 20% FCS | CD19, Folate Receptor beta (FRbeta), TGFbeta, CD179b, NKG2DNKG2D, FLT3, CD179a |

TABLE A-continued

| Cell line | Culture Conditions | Exemplary CAR Target Antigens Expressed |
|---|---|---|
| MV:411 | RPMI, 10% FCS | FLT3, CD123, FRbeta |
| Raji | RPMI, 10% FCS | CD19, CD20, CD22, BCMA, CD38, CD70, CD79, Folate Receptor beta, CLL1 |
| HEL-92.1.7 (HEL) | RPMI, 10% FCS | MPL, CD33, CD32, CD200R |
| Jurkat | RPMI, 10% FCS | TnAg, TSLRP, TSHR, CD4, CD38 |
| Daudi | RPMI, 10% FCS | BCMA, FRbeta |
| REC-1 | RPMI, 10% FCS | NKG2DNKG2D, ROR1 |
| KG-1 | RPMI, 20% FCS | CD33, CD34, CD123, TSLRP |
| CEM | RPMI, 10% FCS | CD5, CD43 |
| U937 | RPMI, 10% FCS | CD4, CLL1 |
| LAMA5 | RPMI, 10% FCS | WT1/HLA-A2 |
| A549 | DMEM, 10% FCS | ROR1, CD22, TIM1, CDH17 |
| HT29 | DMEM, 10% FCS | EGFR, SLEA, c-MET |
| Molm-13 | RPMI, 20% FCS | FLT3, IL6R, LAMP1, TSLRP, CD4, CSF2RA, CXCR4, IL6R, CSF2RA, GPC3 |
| A431 | DMEM, 10% FCS | EGFR, Folate Receptor Alpha, Her3 |
| P19 | DMEM, 10% FCS | SSEA |
| THP-1 | RPMI, 10% FCS | CD32, CD33, CXCR4, CD123, CD44, IL6R, Folate Receptor beta, CD70, LAMP1, FLT3, CSF2RA |
| U87MG | DMEM, 10% FCS | CD276, gpNMB, IL13RA2 |
| LoVo | DMEM, 10% FCS | Tissue Factor, CDH17, EGFR |
| SKOV-3 | DMEM, 10% FCS | Folate Receptor alpha (FR1), FSHR, Her2, Her3, LHR, MSLN, TIM1, EPCAM |
| NCI-H1993 | DMEM, 10% FCS | EGFR |
| Kasumi-1 | RPMI, 20% FCS | CLEC5A, PR1/HLA-A2, TGFbeta, |
| Jeko-1 | RPMI, 20% FCS | BCMA, ROR1 |
| PC-3 | DMEM, 10% FCS | CGH, TROP2, PSCA, PSMA. EPCAM, FSHR, CLD18A2 (CLDN18.2) |
| HeLa | DMEM, 10% FCS | EGFR, FR1, MSLN, TSHR |
| LnCap | DMEM, 10% FCS | EGFR, FSHR, PSCA, PSMA, CD22, Her3, CD22, LHR, CLD18A2 (CLDN18.2) |
| OVCAR-3 | DMEM, 10% FCS | B7H4, CDH6, DLL3, FR1, FSH, LHR, MSLN, PTK7, TnAg, TSHR, L1CAM |
| MEL-624 | DMEM, 10% FCS | CDH19, GD2, GD3, gp100/HLA-A2, gpNMB, HMWMAA, NYESO/HLA-A2, MART1/HLA-A2 |
| LS174-T | DMEM, 10% FCS | CEA |
| MEL-526 | DMEM, 10% FCS | GD2 |
| MDA-MB231 | DMEM, 10% FCS | CD324, Muc1 |
| L1236 | RPMI, 20% FCS | CD30, CD23, PDL1 |
| L428 | RPMI, 20% FCS | CD30, CD123, CCR4, PDL1 |
| L540 | RPMI, 20% FCS | CD30, CCR4, PDL1 |
| Molt-16 | RPMI, 20% FCS | IL1ra, NKG2DNKG2D |
| CEM | RPMI, 10% FCS | CD5 |
| MG-63 | DMEM, 10% FCS | IL13RA2 |
| Karpass-299 | RPMI, 20% FCS | Alk, GPRC, PDL1 |
| MCF7 | DMEM, 10% FCS | B7D4, CD276, TROP2, Her3, Muc1, LewisY, LHR |
| AA-2 | RPMI, 10% FCS | HIV1 env glycoprotein (gp120) |
| HL2/3 | DMEM, 10% FCS | HIV1 env glycoprotein (gp120) |
| TF228.1.16 | DMEM, 10% FCS | HIV1 env glycoprotein (gp120), CCR4 |
| TT | DMEM, 10% FCS | TGF-Beta, TSHR, GFRalpha4 |
| DMS79 | RPMI, 10% FCS | Fucosyl-GM1, Slea (CA19.9; Sialyl Lewis Antigen) |
| LAN-5 | DMEM, 10% FCS | ALK, DLL3, GFRalpha4, FUCOSYL-GM1 |
| PEER1 | RPMI, 10% FCS | TSHR |
| SK-MEL-37 | DMEM, 10% FCS | DLL3, GD2 |
| F9 | DMEM, 10% FCS | SSEA |
| HepG2 | DMEM, 10% FBS | GPC3, AFP/HLA-A2 |

Jurkat cell line (clone E6-1) engineered with a NFAT-dependent EGFP (or GFP) reporter gene was a gift from Dr. Arthur Weiss at University of California San Francisco and have been described to study CAR-signaling ((Wu, C Y et al., Science 350:293-302, 2015). Jurkat cells were maintained in RPMI-1640 medium supplemented with 10% FBS, penicillin and streptomycin.

Generation of Lentiviral Vectors Encoding Chimeric Antigen Receptors Against MPL The pLENTI-Blast vector was derived from pLenti6v5gw_lacz vector (Invitrogen; ThermoFisher Scientific) by removal of the LacZ gene. pLenti-MP2 was a gift from Pantelis Tsoulfas (Addgene plasmid #36097) and was used to generate pLenti-EF1a or pLenti-EF1α [SEQ ID NO: 1] lentiviral vector by replacement of the CMV promoter with human EF1α promoter using standard molecular biology techniques. pLenti-EF1a-DWPRE [SEQ ID NO: 2] was derived from the pLENTI-EF1α vector by deletion of WPRE sequence. The sequence of pCCLc-MNDU3 Vector is provided in SEQ ID NO: 3. The psPAX2 vector was a gift from Didier Trono (Addgene plasmid #12260). The pLP/VSVG envelope plasmid and 293FT cells were obtained from Invitrogen (ThermoFisher Scientific). The retroviral transfer vector MSCVneo, MSCVhygro, and MSCVpac and the packaging vector pKAT have been described previously (PCT/US2018/53247). phRGTK *Renilla* Luciferase plasmid was from Promega.

The generation of Chimeric antigen receptor (e.g., 2nd generation CARs, SIRs, Ab-TCR and TFP etc.) the generation and use of GGS-NLuc fusion proteins, and the generation and use of luciferase (e.g., GLuc) reporter cell lines for measurement of cellular cytotoxicity using the Matador assays have been described (PCT/US2017/024843, PCT/US2017/025602, PCT/US2017/052344, PCT/US2017/064379 and PCT/US2018/53247).

Lentivirus and Retrovirus Vectors

Lentiviruses were generated by calcium phosphate based transfection in 293FT cells essentially as described previously (Matta H et al, Cancer biology and therapy. 2(2):206-10. 2003). 293FT cells were grown in DMEM with 10% FCS 4 mM L-Glutamine, 0.1 mM MEM Non-Essential Amino Acids, and 1 mM MEM Sodium Pyruvate (hereby referred to as DMEM-10). For generation of lentivirus, 293FT cells were plated in 10 ml of DMEM-10 medium without antibiotics in a 10 cm tissue culture plate so that they will be approximately 80% confluent on the day of transfection. The following day, the cells were transfected by calcium phosphate transfection method using 10 μg of lentiviral expression plasmid encoding different genes, 7.5 μg of PSPAX2 plasmid and 2 μg of PLP/VSVG plasmid. Approximately 15-16 hours post-transfection, 9 ml of media was removed and replaced with 5 ml of fresh media. Approximately, 48 hours post-transfection, 5 ml of supernatant was collected (first collection) and replaced with fresh 5 ml media. Approximately 72 hrs post-transfection, all media was collected (second collection, usually around 6 ml). The collected supernatants were pooled and centrifuged at 1000 rpm for 1 minute to remove any cell debris and non-adherent cells. The cell-free supernatant was filtered through 0.45 μm syringe filter. In some cases, the supernatant was further concentrated by ultra-centrifugation at 18500 rpm for 2 hours at 4° C. The viral pellet was re-suspended in 1/10 of the initial volume in XVIVO medium. The virus was either used fresh to infect the target cells or stored frozen in aliquots at −80° C.

Infection of T Cells and PBMC

Buffy coat cells were obtained from healthy de-identified adult donors from the Blood Bank at Children Hospital of Los Angeles and used to isolate peripheral blood mononuclear cells (PBMC) by Ficoll-Hypaque gradient centrifugation. PBMC were either used as such or used to isolate T cells using CD3 magnetic microbeads (Miltenyi Biotech) and following the manufacturer's instructions. PBMC or isolated T cells were re-suspended in XVIVO medium (Lonza) supplanted with 10 ng/ml CD3 antibody, 10 ng/ml CD28 antibody and 100 IU recombinant human-IL2. Cells were cultured at 37° C., in a 5% CO2 humidified incubator. Cells were activated in the above medium for 1 day prior to infection with lentiviral vectors. In general, primary cells (e.g. T cells) were infected in the morning using spin-infection (1800 rpm for 90 minutes at 37° C. with 300 μl of concentrated virus that had been re-suspended in XVIVO medium in the presence of 8 μg/ml of Polybrene® (Sigma, Catalog no. H9268). The media was changed in the evening and the infection was repeated for two more days for a total of 3 infections. After the 3rd infection, the cells were pelleted and resuspended in fresh XVIVO media containing 10 ng/ml CD3 antibody, 10 ng/ml CD28 antibody and 100 IU recombinant human-IL2 and supplemented with respective antibiotics (if indicated) and place in the cell culture flask for selection, unless indicated otherwise. Cells were cultured in the above medium for 10-15 days in case no drug selection was used and for 20-30 days in case drug-selection was used. In cases, where cells were infected with a lentivirus expressing EGFP, they were expanded without drug-selection or flow-sorted to enrich for EGFP-expressing cells. For infection of cancer cell lines, approximately 500,000 cells were infected with 2 ml of the un-concentrated viral supernatant in a total volume of 3 ml with Polybrene® (Sigma, Catalog no. H9268). Then next morning, the cells were pelleted and resuspended in the media with respective antibiotics and place in the cell culture flask for selection.

Essentially a similar procedure as described above for lentivirus vector production was used for generation of retroviral vectors with the exception that 293FT cells were generally transfected in 10 cm tissue culture plates in 10 ml of DMEM-10 medium using 10 μg of retroviral construct, 4 μg of pKAT and 2 μg of VSVG plasmid. The virus collection and infection of target cells was carried out essentially as described above for lentiviral vectors.

Antibodies and Drugs

Blinatumomab was obtained from Amgen. Digitonin was purchased from Sigma (Cat. no D141) and a stock solution of 100 mg/ml was made in DMSO. A diluted stock of 1 mg/ml was made in PBS. Final concentration of digitonin used for cell lysis was 30 μg/ml unless indicated otherwise.

ELISA

Human IL2, IFNγ, IL6 and TNFα were measured in the cell culture supernatant of CAR-expressing Jurkat-NFAT-GFP effector cells or T cells that had been co-cultured with the specific target cell lines for 24 to 96 hours using commercially available ELISA kits from R&D systems (Minneapolis, MN) and BD Biosciences and following the recommendations of the manufacturer.

FACS Analysis for Detecting Expression of CAR

Mouse Anti-Human c-Myc APC-conjugated Monoclonal Antibody (Catalog #IC3696A) was from R&D Systems (Minneapolis, MN). Biotinylated protein L was purchased from GeneScript (Piscataway, NJ), reconstituted in phosphate buffered saline (PBS) at 1 mg/ml and stored at 4° C. Streptavidin-APC (SA1005) was purchased from ThermoFisher Scientific.

For detection of CARs using Myc staining, $1\times10^6$ cells were harvested and washed three times with 3 ml of ice-cold 1×PBS containing 4% bovine serum albumin (BSA) wash buffer. After wash, cells were resuspended in 0.1 ml of the ice-cold wash buffer containing 10 μl of APC-conjugated Myc antibody and incubated in dark for 1 hour followed by two washings with ice cold wash buffer.

For detection of CARs using Protein L staining, $1\times10^6$ cells were harvested and washed three times with 3 ml of ice-cold 1×PBS containing 4% bovine serum albumin (BSA) wash buffer. After wash, cells were resuspended in 0.1 ml of the ice-cold wash buffer containing 1 μg of protein L at 4° C. for 1 hour. Cells were washed three times with ice-cold wash buffer, and then incubated (in the dark) with 10 μl of APC-conjugated streptavidin in 0.1 ml of the wash buffer for 30 minutes followed by two washings with ice cold wash buffer. FACS was done using FACSVerse analyzer from BD Biosciences.

Cell Death Assay

To measure cell death, a novel assay based on ectopic cytosolic expression of Gluc, NLuc and other luciferases was utilized as described in PCT/US2017/052344 "A Non-Radioactive Cytotoxicity Assay". The method involves expression of a reporter in a target cells in a manner so that it is typically retained within the healthy cells but is either released from dead and dying cells or whose activity can be preferentially measured in dead and dying cells. T cells mediated induction of lysis of target cells was assayed by increase of luciferase activity as measured by BioTek synergy plate reader by directly injecting 0.5×CTZ assay buffer containing native coeloentrazine (Nanaolight).

CTZ Assay

A 100× stock solution of native coelenterazine (CTZ; Nanolight, cat #303) was made by dissolving 1 mg of lyophilized CTZ powder in 1.1 ml of 100% Methanol supplemented with 30 μl of 6N HCl to avoid oxidation of CTZ with time. To make CTZ assay buffer, the 100× stock solution of CTZ was diluted to 0.5× concentration in PBS. Unless indicated otherwise, a total volume of 15 μl of the CTZ assay buffer (as prepared above) was added to each well of a 384-well white plate (Greiner, 384 well white plate cat #781075) containing cells expressing the non-secretory form of the luciferase in approximately 50-60 μl volume of medium and plates were read for luminescence using BioTek synergyH4 plate reader. For 96 well plates, cells were plated in 200 μl of media and approximately 50 μl of 0.5×CTZ assay buffer was added. Unless indicated otherwise, the 0.5×CTZ assay buffer was used for assaying the activity of GLuc, TurboLuc16, and MLuc7. The CTZ assay buffer (diluted to 0.125× concentration) was also used for measurement of NLuc activity in some experiments. In general, unless indicated otherwise, the volume of 0.5×CTZ assay buffer added was approximately ¼th of the volume of the liquid in the well containing the cells, although the assay also worked when the 0.5×CTZ assay was added to the media containing the cells in 1:1 volume. Gluc activity in wells containing media alone (Med) and in wells in which target cells were incubated with T cells that were not infected with any CAR construct (T-UI) were used as controls, where indicated.

Assay to Detect the Expression of Antigens on Target Cells and to Determine the Antigen Binding Activity of Various Antigen Binding Moieties Used in the Construction of the CARS and BiTes The expression of antigens on target cells was determined by bioinformatics approaches in combination with immunostaining with antigen specific antibodies or a highly sensitive antigen detection assay as described in PCT/US2017/025602 and incorporated herein in its entirety by reference. This assay involves the fusion of a GLuc or NLuc reporter fragment tot the antigen binding domain of an antibody, a scFv, a vHH or any other antigen binding fragment or any receptor and ligand. The resulting fusion protein is incubated with the target cells expressing the test antigen and the binding of the fusion protein is determined by addition of coelentrazine or other suitable substrate of the luciferase reporter. The SEQ ID Nos of the exemplary soluble forms of several antigens containing their extracellular domains in fusion with Luc are provided in Table 10. These constructs also carry a puromycin resistance gene (PAC), which is optional and not needed for the functionality of the soluble proteins. The SEQ ID Nos of the exemplary scFv in fusion with Luc are provided in Table 11.

Example 1: Inhibition of Infection of CD19+ Raji Cells by Lentiviral Vector Encoding a CD19 Car by a CD19 Antibody A CAR targeting CD19 (FMC63-M1u-MYC-CD8TM-BBZ-T2A-eGFP) and co-expressing enhanced green fluorescent protein (EGFP) was constructed in pCCLc-MNDU3 vector (SEQ ID NO: 3). The nucleic acid and amino acid SEQ ID Nos of this CAR construct are represented by SEQ ID NO: 11918 and 12051, respectively. Lentivirus was generated in 293FT cells and concentrated as described previously. RAJI (CD19+) cells were left untreated or incubated with supernatant containing the FMC63-scFv-GGS-NLuc fusion protein (SEQ ID NO: 6074), a FMC63-PE mouse monoclonal antibody or an isotype control mouse IgG. Subsequently, cells were infected using spin-infection with 200 μl of concentrated lentivirus particles encoding the CAR construct FMC63-M1u-MYC-CD8TM-BBZ-T2A-eGFP in the presence of polybrene. Approximately 4 days later, the % of RAJI cells transduced with the CAR constructs were determined by examining the expression of EGFP by FACS. As shown in the following Table 1, FMC63 mouse monoclonal antibody reduced the infection of RAJI cells with the CD19 targeted CAR construct from 44.4% to 27.9% while the control antibody had no significant effect. Similarly, a soluble fusion protein containing the FMC63 single chain variable fragment (scFv) targeting CD19 fused to NLuc (FMC63-scFv-GGSG-NLuc-U09) (SEQ ID NO: 6047) reduced the infection of RAJI cells with the CD19 targeted CAR construct from 44.4% to 36.79%. The experiment was repeated using a clone of RAJI cells (RAJI-CD19KO) in which CD19 expression had been knocked-out using CRISP/Cas9. It was observed that incubation with FMC63 antibody had no significant effect on the infectivity of RAJI-CD19KO cells when infected with the the CAR construct FMC63-M1u-MYC-CD8TM-BBZ-T2A-eGFP. Finally, coimmunoprecipitation was performed on the concentrated viral particles with an antibody against an epitope present on the CAR polypeptide followed by wetem blotting with an antibody against the VSVG protein. The results revealed that the CAR polypeptide is inserted into the envelope of the lentiviral particles. Taken collectively, these results demonstrate that the accidental insertion of a CAR construct targeting an antigen (e.g., CD19) into cancer cells (e.g., RAJI) expressing that antigen (e.g., CD19) can be blocked by an agent (e.g., an antibody or scFv) that binds to the said antigen.

TABLE 22

| | | | | % EGFP + RAJI Cells |
|---|---|---|---|---|
| 1 | Uninfected | | | 0.51% |
| 2 | FMC63-Mlu-MYC-CD8TM-BBZ-T2A-eGFP | | | 44.46% |
| 3 | FMC63-Mlu-MYC-CD8TM-BBZ-T2A-eGFP | + | FMC63-PE mouse monoclonal | 27.92% |
| 4 | FMC63-Mlu-MYC-CD8TM-BBZ-T2A-eGFP | + | Control IgG | 43.33% |
| 5 | FMC63-Mlu-MYC-CD8TM-BBZ-T2A-eGFP | + | FMC63-scFv-GGSG-Nluc-U09 | 36.79% |

Example 2: Inhibition of Infection of CD19+ Raji Cells by Lentiviral Vector Encoding a CD19 Car by a CD19 Antibody The experiment was conducted as in example 1 with the exception that a Mesothelin specific CAR co-expressing EGFP (MSLN-237-HL-M1u-CD8TM-BBZ-T2A-eGFP) was included as a negative control. The nucleic acid and amino acid SEQ ID Nos of this CAR construct are 11919 and 12052, respectively. Lentiviruses were generated in 293FT cells and concentrated as described previously. RAJI (CD19+) cells were left untreated or incubated with a FMC63-PE mouse monoclonal antibody or an isotype control mouse IgG. Subsequently, cells were infected using spin-infection with 200 μl of concentrated lentivirus particles encoding the CAR construct FMC63-M1u-MYC-CD8TM-BBZ-T2A-eGFP (SEQ ID NO: 11918 and SEQ ID NO (PRT): 12051) and MSLN-237-HL-M1u-CD8TM-BBZ-T2A-eGFP (SEQ ID NO: 11919 and 12052) in the presence of polybrene. Approximately 2 days later, the % of RAJI cells transduced with the CAR constructs were determined by examining the expression of EGFP by FACS. As shown in the following Table 2, FMC63 mouse monoclonal antibody reduced the infection of RAJI cells with the CD19 targeted CAR construct from 27.9% to 19.24% as measured by % EGFP cells while the control antibody had no significant effect (% EGFP cell=29.58%). In contrast, treatment with FMC63-PE antibody had no significant effect on infection of RAJI cells with the mesothelin CAR construct as the % of EGFP cells was approximately 20.89%, 20.41% and 20.97% in untreated cells, FMC63-PE-treated cells and control mouse IgG-PE treated cells. These results demonstrate that the CD19 monoclonal antibody FMC63 specifically blocks the infectivity of the CD19 directed CAR and has no effect on the infectivity of the Mesothelin CAR.

TABLE 23

| | Target CELL | Lentivirus | | Antibody | % EGFP + RAJI Cells |
|---|---|---|---|---|---|
| 1 | RAJI-WT | Uninfected | | | 0.28% |
| 2 | RAJI-WT | FMC63-Mlu-MYC-CD8TM-BBZ-T2A-eGFPter | | | 27.99% |
| 3 | RAJI-WT | FMC63-Mlu-MYC-CD8TM-BBZ-T2A-eGFPter | + | FMC 63-PE mouse monoclonal | 19.24% |

TABLE 23-continued

| | Target CELL | Lentivirus | | Antibody | % EGFP + RAJI Cells |
|---|---|---|---|---|---|
| 4 | RAJI-WT | FMC63-Mlu-MYC-CD8TM-BBZ-T2A-eGFPter | + | Control IgG-PE | 29.58% |
| 5 | RAJI-WT | MSLN-237-HL-Mlu-CD8TM-BBZ-T2A-eGFPter | | | 20.89% |
| 6 | RAJI-WT | MSLN-237-HL-Mlu-CD8TM-BBZ-T2A-eGFPter | + | FMC63-PE mouse monoclonal | 20.97% |
| 7 | RAJI-WT | MSLN-237-HL-Mlu-CD8TM-BBZ-T2A-eGFPter | + | Control IgG-PE | 20.41% |

Example 3

The experiment in the preceding example is repeated using a lentiviral vector encoding a CD19 CAR (SEQ ID NO: 11920) comprising a scFV derived from an antibody other than FMC63 as its antigen-binding domain. The CAR is cloned in the pCCLc-MNDU3-WPRE lentiviral vector (SEQ ID NO: 3) and the resulting vector is packaged using VSVG as described in the preceding example. It is observed that incubation of NALM6 (B cell acute lymphocytic leukemia cells) with FMC63 antibody is able to reduce infection by the CD19 CAR (SEQ ID NO: 11920). In contrast, incubation with Rituximab, a CD20 antibody, had no effect. These results demonstrate that it is possible to reduce accidental insertion of an ABR (e.g. a CAR) by using an antibody that binds to the target antigen of the ABR (e.g. a CAR) but is different from the antibody from which the antigen binding domain of the ABR is derived.

Example 4

In another example, the infection by lentiviral vectors encoding a FMC63 scFV-based CD19 TFPε, CD19 TFPγ, CD19 TFPδ and CD19 TAC are similarly inhibited by incubation of the viral preparations with FMC63 antibody.

Example 5

Figure 2A:
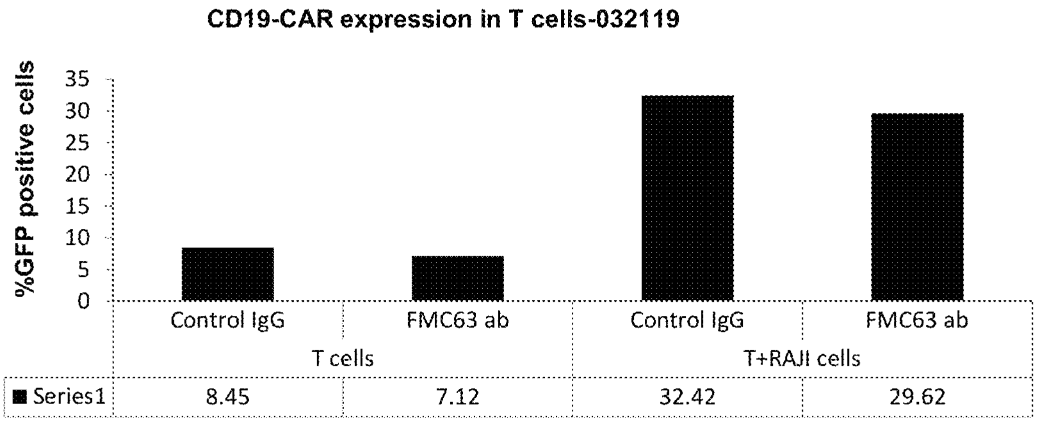
FIG. 2A-B depicts that a CD19 targeted monoclonal antibody FMC63 does not reduce the infection of a CD19 targeted CAR into T cells (FIG. 2A) while reducing the infection of the CD19 targeted CAR into RAJI cells (FIG. 2B).
Figure 2B:
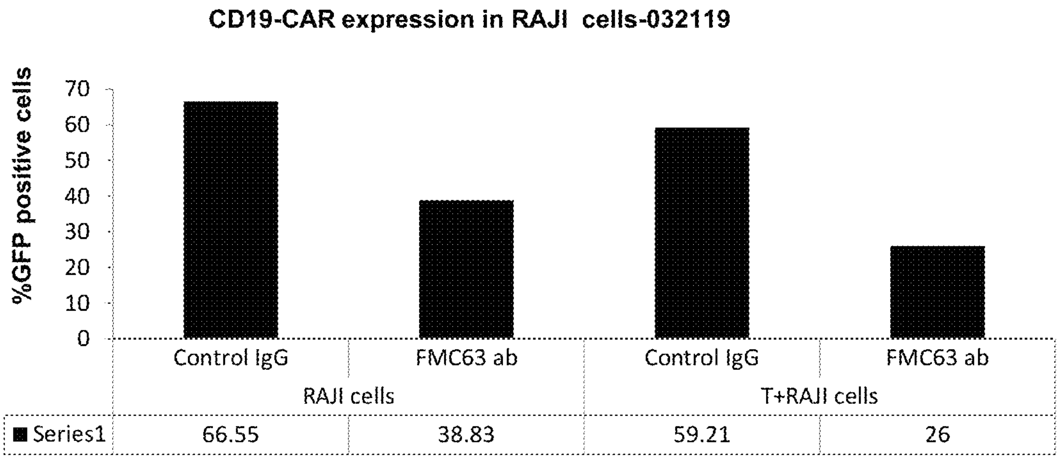

FMC63 antibody has no deleterious effect on infection of T cells by FMC63 based CD19 CAR T cells (isolated using CD3 beads) are plated alone at 1 million/well in 2 ml of T cell culture medium in 4 wells of a 6-well plate. RAJI cells are plated alone at 1 million/well in 2 ml of T cell culture medium in 4 wells of a 6-well plate. T cells (0.5 million) plus RAJI cells (0.5 million) are plated in 4 wells of a 6-well plate. All the cells were treated with control IgG (MABC004 GC270, Millipore) or FMC63 antibody (MAB 1794, Millipore) at final concentration of 1 μg/ml for 1 hr at 4° C. followed by infection with concentrated lentivirus encoding a CD19 CAR and co-expressing GFP (FMC63-CD8TM-BBz-2A-GFP). Infection was done using spinfection at 2800 rpm at 32° C. for 90 minutes in the presence of in the presence of 8 μg/ml of Polybrene® (Sigma, Catalog no. H9268). Plates were incubated at 37° C. for 3-4 hrs after spinfection. Medium was changed to T cell medium (XVIVO medium (Lonza) supplanted with 5% hAB serum, 10 ng/ml CD3 antibody, 10 ng/ml CD28 antibody and 100 IU recombinant human-IL2). Three days post infection, cells were stained with CD3-Bv421 to gate on T cells and GFP-expressing cells were determined by flow cytometry. FIG. 2A shows that incubation with FMC63 antibody had no significant effect on the infection of T cells with the FMC63-scFV-based CD19 CAR when the T cells were infected alone or in the presence of RAJI cells. However, FMC63 antibody significantly reduced the infection of RAJI cells with the FMC63-scFV-based CD19 CAR (FIG. 2B). These results demonstrate that it is possible to prevent accidental insertion of a CAR into cancer cells (e.g., leukemia or lymphoma cells) expressing the CAR-antigen without compromising the ability of the CAR construct to infect T cells which do not express the CAR antigen.

Example 6

Generation of CAR-T from Leukophered Product Obtained from a Patient with Circulating CD19-Expressing B-Cell Acute Lymphocytic Leukemia Blasts.

A leukophersis product is obtained from a 25 years old patient with CD19-expressing B-cell Acute Lymphocytic Leukemia using standard procedure. Patient has high number of circulating leukemia blasts at the time of leukopheresis. The leukopheresis product undergoes Ficoll-Hypaqe separation to enrich for mononuclear cells. Approximately 100 million mononuclear cells are re-suspended in XVIVO medium (Lonza) supplanted with 10 ng/ml CD3 antibody, 10 ng/ml CD28 antibody and 100 IU recombinant human-IL2. Cells are cultured at 37° C., in a 5% CO2 humidified incubator. Cells are activated in the above medium for 1 day prior to infection a lentiviral vector expressing a CAR targeting CD19 (SEQ ID NO: 1456). Prior to infection, the mononuclear cells are incubated with cGMP grade FMC63 monoclonal antibody at a concentration of 10 μg/ml for 1 hour at 4° C. Cells (e.g. T cells) are infected using spin-infection at 1800 rpm for 90 minutes at 37° C. with concentrated virus that has been re-suspended in XVIVO medium. Infection is carried out in the presence of FMC63 monoclonal antibody (10 μg/ml) and Polybrene® (Sigma, Catalog no. H9268) at concentration of 8 μg/ml. After the infection, the cells are pelleted and resuspended in fresh XVIVO media containing 10 ng/ml CD3 antibody, 10 ng/ml CD28 antibody and 100 IU recombinant human-IL2 and expanded for 10 days at 37° C. in a 5% $CO_2$ humidified incubator. Infection with the CD19 CAR encoding lentiviral vector in the presence of FMC63 antibody is shown to reduce the infection of the CD19-expressing leukemia blasts with the CAR construct without significantly affecting the infection of the T cells. Inclusino of FMC63 antibody at the time of infection with lentiviral vectors encoding different CD19 CAR constructs (SEQ ID NO: 1455 and 1461) is similarly found to reduce the accidental infection of CD19-expressing leukemia cells with the CAR constructs without significantly affecting the infection of the T cells or their subsequent expansion and functionality.

Example 7

A Luciferase Based Reporter Assay for Determining the Relative Titer of a Lentiviral Vector A nucleic acid fragment encoding SecNLuc fused in frame with CD28 hinge and transmembrane regions (SEQ ID NO: 11951) was cloned in the mammalian expression vector pSecTagA (SEQ ID NO: 12048) between the Nhe I and Xba I sites to generate a vector named Psectag-SecNLuc-CD28-Hinge-TM (SEQ ID NO: 12049. The following lentiviral vectors encoding mCherry, mOrange or EGFP were transfected into 293FT cells along with packaging plasmids and VSVG and Psectag-SecNLuc-CD28-Hinge-TM vector. Lentiviruses were generated by transfection of packaging plasmids into 293FT cells. 293FT cells were grown in DMEM with 10% FCS 4 mM L-Glutamine, 0.1 mM MEM Non-Essential Amino Acids, and 1 mM MEM Sodium Pyruvate (hereby referred to as DMEM-10). For generation of lentivirus, 293FT cells were plated in 10 ml of DMEM-10 medium without antibiotics in a 10 cm tissue culture plate so that they will be approximately 80% confluent on the day of transfection. The following day, the cells were transfected using 10 μg of lentiviral expression plasmid encoding different CARs, 7.5 μg of PSPAX2 plasmid and 2 μg of PLP/VSVG plasmid and 500 ng of PsecTag-SecNLuc-CD28-Hinge-TM vector. Approximately 48 hours post-transfection, 5 ml of supernatant was collected (first collection) and replaced with fresh 5 ml media. Approximately 72 hrs post-transfection, all media was collected (second collection, usually around 6 ml). The collected supernatants were pooled and centrifuged at 1000 rpm for 1 minute to remove any cell debris and non-adherent cells. The cell-free supernatant was filtered through 0.45 pin syringe filter. In some cases, the supernatant was further concentrated by ultra-centrifugation at 18500 rpm for 2 hours at 4° C. The viral pellet was re-suspended in 1/10 of the initial volume in XVIVO medium. In order to measure virus associated NLuc activity, 2 μl and 5 μl of the different viruses were diluted in 100 μl of phosphate buffer saline (PBS) and divided into 3 wells of a flat-bottom 384 well plate (Greiner, 384 well white plate cat. #781075). NLuc activity was measured by injecting 30 μl/well of coelenterazine assay buffer using an automatic dispenser in a well mode using a BioTek synergy H4 plate reader and light emission as a measure of NLuc activity was measured.

TABLE 24

Virus associated NLuc activity using 2 μl of concentrated virus

| | MEAN | STD |
|---|---|---|
| Blank | 14.7 | 0.8 |
| Control Vector | 21.0 | 1.3 |
| mCherry-JC7 + SecNLuc-CD28-Hinge-TM | 29945.7 | 684.1 |
| mCherry-JD3 + SecNLuc-CD28-Hinge-TM | 10319.7 | 372.9 |
| eGFP-JE1 + SecNLuc-CD28TM-Hinge | 3267.7 | 49.7 |

TABLE 25

Virus associated NLuc activity using 5 μl of concentrated virus

| | MEAN | STD |
|---|---|---|
| Blank | 10.67 | 0.29 |
| Control Vector | 25.67 | 1.61 |
| mCherry-JC7 + SecNLuc-CD28-Hinge-TM | 85592.33 | 1663.01 |
| mCherry-JD3 + SecNLuc-CD28-Hinge-TM | 32923.33 | 2136.69 |
| eGFP-JE1 + SecNLuc-CD28TM-Hinge | 9657.67 | 119.02 |

Example 8

A Luciferase Based Reporter Assay for Determining the Relative Titer of a Lentiviral Vector Approximately 100 μl of virus was used to infect JNG (Jurkat cells expressing EGFP under an NFAT promoter) cells by spinfection in the presence of 8 μg/ml of Polybrene® (Sigma, Catalog no. H9268). Approximately 48 hour post-infection, cells were examined by flow cytometry to determine the percentage of cells showing the expression of different fluorescent proteins.

TABLE 26

Percentage of lentiviral infected JNG cells as measured by expression of fluorescent proteins (e.g., mCherry or eGFP).

| Name | % Infected Cells |
|---|---|
| JNG-Parental (Control) | 0.88 |
| JNG-mCherry-JC7 | 55.84 |
| JNG-mCherry-JD3 | 27.78 |
| JNG-eGFP-JE1 | 10.54 |

Example 9

Figure 3A:
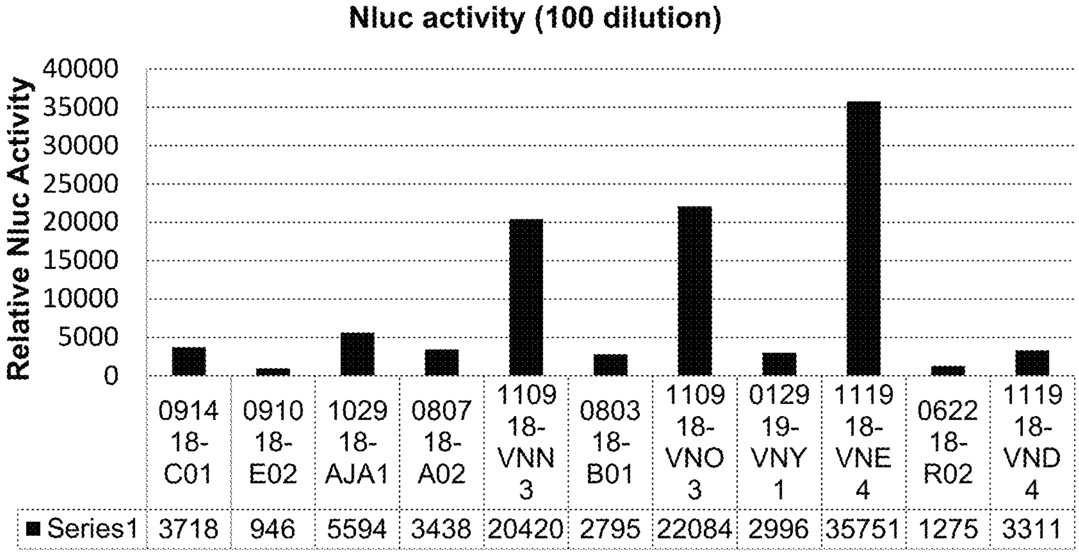
FIG. 3A-B depicts that there is a good correlation between the titer of different lentiviral vector preparations as measured by luciferase based reporter assay (FIG. 3A) and p24 ELISA (FIG. 3B).
Figure 3B:
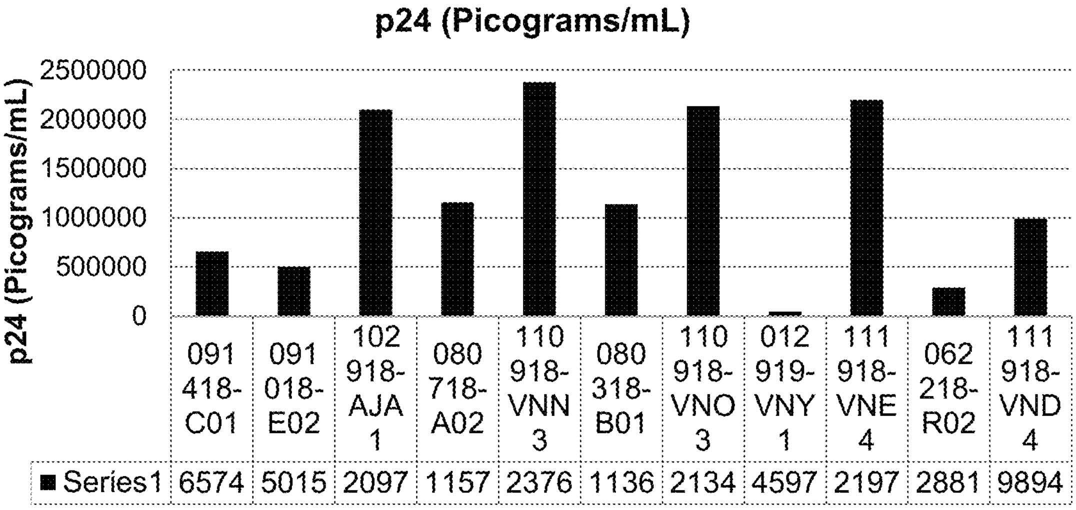

A Luciferase Based Reporter Assay for Determining the Relative Titer of a Lentiviral Vector The lentiviruses are generated from a number of lentiviral vectors as described in the preceding example. The virus particles are concentrated. The viral particle associated Nluc activity is measured as described above using colentrazine. In addition, viral particle associated p24 level, a conventional measure of viral titer, is measured by ELISA using a kit obtained from Clontech. A good correlation is seen between the viral titer measured using Nluc activity and p24 level (FIGS. 3A-B).

Example 10

The above results demonstrate that SecNLuc-CD28-Hinge-TM protein gets associated with the lentiviral particles when it is cotransfected with the lentiviral transfer plasmids and packaging plasmids. Second, the viral associated SecNLuc-CD28-Hinge-TM protein is stably associated with the viral particles and is not lost upon centrifugation of the viral supernatant to concentrate the virus. Third, the lentiviral particles with the associated SecNLuc-CD28-Hinge-TM protein retain their ability to infect the target cells and stably transduce the gene encoded by the transfer vector (e.g., mCherry or eGFP). Fourth, there is a linear increase in NLuc activity with increase in the amount of the virus used for the assay. Fifth, there is a good correlation between the viral associated NLuc activity of a particular viral preparation and the ability of that viral preparation to infect the target cells. Sixth, there is a good correlation between the viral associated NLuc activity of a particular viral preparation and viral titer as measured by p24 ELISA. Thus, viral associated NLuc activity can be used as a simple, convenient, fast and economical assay for the measurement of viral titer.

Example 11

A Reporter Assay for Determining the Relative Titer of a Lentiviral Vector

The experiment is repeated by replacing PsecTag vector encoding SecNLuc-CD28-Hinge-TM with PsecTag vectors encoding SecNLuc-CD8-Hinge-TM-BB-L4 (SEQ ID NO: 11982) and SecNLuc-GPI (SEQ ID NO: 12013) and essentially similar results are obtained.

Example 12: A Reporter Assay for Determining the Relative Titer of a Lentiviral Vector The experiment is repeated in which the luciferases reporter gene is co-expressed with the VSVG gene (SEQ ID NO: 119171) from a single pcDNA3 based vector (SEQ ID NO: 11915) and the two genes are separated from each other by a 2A cleavage sequence. Exemplary such gene cassettes are represented by SEQ ID NO: 12044-12046. Essentially similar results are obtained. The experiment is also repeated in which the VSVG gene and the reporter gene are expressed from the single pCDNA3 based vector but the two genes are separated by an IRES sequence (e.g., SEQ ID NO: 11916). Essentially similar results as above are obtained.

Example 13: A Reporter Assay for Determining the Relative Titer of a Lentiviral Vector Further, essentially similar results are obtained upon substitution of SecNLuc in the above constructs with other marine luciferases (e.g., Gluc, TurboLuc16, MLuc7, LoLuc, HtLuc, PaLuc etc.) or *Renilla* Luciferase. The experiment is repeated by replacing PsecTag vector encoding SecNLuc-CD28-Hinge-TM with a pcDNA3 vector (SEQ ID NO: 11915) encoding cytosolic form of GLuc (SEQ ID NO: 11921) and similar results are obtained. The assay can be also performed by substituting marine luciferases (e.g., SecNLuc, Gluc etc.) with other luciferase (e.g., firefly luciferase or Fluc, LucPPe-146-1H2, LucPpL-81-6G1 and CBGRluc-GPI etc.) except that the viral associated luciferase activity is measured by addition of D-luciferin as the substrate. Finally, other reporters, such as eGFP, mCherry and alkaline phosphatase can be used in place of SecNLuc as the reporter. The activity of the fluorescent protein based reporters is measured by measurement of viral-associated fluorescence while viral associated alkaline phosphatase activity is measured upon addition of its substrate p-nitrophenyl phosphate using methods known in the art. The SEQ ID Nos of constructs encoding the cytosolic and membrane associated or membrane anchored forms of the above reporters is provided in Tables 19 and 20.

Example 14. Expression of CD19 Antigen Masking Receptors into Raji and NALM6 Cells A panel of CARs targeting CD19 were generated using antigen binding domains derived from FMC63 (SEQ ID NO: 205), hu-mROO5-1 (SEQ ID NO: 211) and CD19-MM (SEQ ID NO: 209) scFVs respectively. The nucleic acid and amino acid SEQ ID NO of the CARs are presented in Table 21. The CARs were generated on 2nd generation CAR backbone with 41BB costimulatory domain (SEQ ID NO: 12228, 12230 and 12234) double chain SIR (SEQ ID NO: 12229 and 12233), TFPε (SEQ ID NO: 12231 and 12235) and TFPδ (SEQ ID NO: 12232 and 12236) backbones. The constructs also co-expressed a puromycin resistance gene (PAC). The lentiviral vectors encoding the different CAR constructs were used to infect RAJI (CD19+) cells. The cells were selected with puromycin. Flow cytometry with PE-conjugated FMC63 antibody was used to detect the expression of CD19 on the surface of the CAR-expressing cells. There was a significant decrease in FMC63 binding to RAJI cells transduced with FMC63, hu-mROO5-1 and CD19-MM based 2nd generation CARs (SEQ ID NO: 12228, 12230 and 12234), TFPε (SEQ ID NO: 12231 and 12235) and TFPδ (SEQ ID NO: 12232 and 12236). In contrast, there was no decrease in binding of FMC63 to RAJI cells transducted with FMC63 and hu-mROO5-1 based SIRs (SEQ ID NO: 12229 and 12233). Essentially similar results are obtained when the experiment is repeated with CD19-expressing NALM6 (Acute Lymphocytic Leukemia) cells.

In another exemplary experiment, the experiment is repeated with lentiviral vectors encoding FMC63- or hum-mROO5-1-based cTCR, Ab-TCR, TFPαβ and TFPγδ. No decrease in the cell surface expression of CD19, as measured by binding of PE-conjugated FMC63, is observed in RAJI cells transduced with lentiviral vectors encoding cTCR, Ab-TCR, TFPαβ and TFPγδ comprising antigen binding domains based on FMC63 scFV (SEQ ID NO: 205) and hu-mROO5-1 scFv (SEQ ID NO: 211). Collectively, these results demonstrate that some but not all antigen binding receptors (ABR) posses the ability to mask the cell surface expression of an antigen when expressed in cells expressing that antigen.

Example 15: Reversible Control of Antigen Expression Using Antigen Masking Receptor Containing Protein Degradation Domains RAJI cells were infected with the following lentiviral vectors encoding antigen masking receptors targeting CD19 and carrying protein degradation motifs FKBP12. The vector CD8SP-FMC63-(vL-vH)-Myc-BBz-xba-GGS-xho-GGG-FKBP12-F36V-Spe-F-P3A-Nde-PAC (SEQ ID NO (DNA): 12224; SEQ ID NO (PRT): 12237) expresses the F36V mutant of FKBP12 in fusion with the C-terminal region of a FMC63 based CD19 and also expresses a puromycin resistance gene via a 2A exon skipping sequence. RAJI cells were selected with puromycin and examined for CD19 expression by cell surface staining with FMC63 antibody. The transduced cells were found to have significant downregulation of CD19 expression (0.73%) as compared to the control cells (99.15%), suggesting masking of CD19 antigen expression. Subsequently, the cells were treated with dTAG-13 (100 nM) for 24-72 h to induce degradation of the AMR. Treatment with dTAG resulted in upregulation of CD19 expression on the RAJI cells expressing CD8SP-FMC63-(vL-vH)-Myc-BBz-xba-GGS-xho-GGG-FKBP12-F36V-Spe-F-P3A-Nde-PAC (SEQ ID NO: 12224), as measured by staining with FMC63-PE antibody, from 0.73% to 68.98%.

In another exemplary embodiment, the experiment is repeated with different doses of dTAG-13 (1 pM to 100 nM) and a dose dependent induction of CD19 expression is observed with increasing concentration of dTAG-13.

Finally, it is observed that RAJI cells expressing CD8SP-FMC63-(vL-vH)-Myc-BBz-xba-GGS-xho-GGG-FKBP12-F36V-Spe-F-P3A-Nde-PAC (SEQ ID NO: 12224) are resistant to killing by CD19-CAR-T cells or Blinatumomab but become sensitized upon exposure to dTAG-13. Collectively, these results demonstrate tunable and reversible control of protein expression using AMR carrying protein degradation motif. A number of other protein degradation motif (degron) that induce protein degradation in the presence of specific drugs are known in the art and can be used in alternate embodiment of the disclosure. For example, cereblon binding motif derived from IKZF1 and IKZF3 can be used in alternate embodiment of the disclosure when combined with IMiDs.

Example 16: Generation of HSCS Expressing Antigen Masking Receptor (Amr) Targeting CD19

Based on the preceding results, CD34 positive hematopoietic stem cells are infected with a lentiviral vector encoding an FMC63-based 2nd generation CAR (SEQ ID NO: 11918). The expression of the FMC63 based CAR is shown to result in masking of CD19 on the surface of B cells produced from the transduced CD34+ stem cells. Further, FMC63-CAR expressing B cells are found to be resistant to killing by CD19-CAR-T cells. Further, FMC63-CAR expressing B cells are found to be resistant to killing by Blinatumomab in the presence of T cells. Essentially similar results are obtained when CD34 cells are transduced with ABR in which FMC63 scFV is joined in frame to CD8 hinge and transmembrane domains but lack the 41BB costimulatory domain or the CD3z activation domain.

Example 17: Generation of HSCs Expressing Amr Targeting CD33, CD123, MPL, FLT3 and BST1

G-CSF mobilized peripheral blood stem cells and bone marrow stem cells are obtained from University of Southern California. CD34+ stem cells are selected by purification using magnetic beads. AMR targeting CD33 (SEQ ID NO: 1749), CD123 (SEQ ID NO: 1763), MPL (SEQ ID NO: 1846), FLT3 (SEQ ID NO: 1810) and BST1 (SEQ ID NO: 1908) are expressed in the CD34+ stem cell using lentiviral mediated gene transfer according to methods known in the art. Analysis of AMR-expressing HSCs shows that the cells have comparable growth in vitro as control HSCs. The control and AMR-expressing HSC are exposed to different T cells expressing CAR (e.g., 2nd generation CAR, TFP, SIR and Ab-TCR) targeting the corresponding antigens. The SEQ ID Nos of the different CAR constructs and the corresponding AMR are shown in the following Table.

TABLE 27

SEQ ID NO OF AMRs capable of protecting hematopoietic cells from cytotoxity of the CAR, TFP, SIR and Ab-TCR targeting the different antigens

| TARGET | AMR (CD8-TM-L4) | CAR (BBz) | TFP | SIR | Ab-TCR |
|---|---|---|---|---|---|
| MPL | 1846 | 1596 | 12191 | 3550 | 4526 |
| CD33 | 1749 | 1499 | 12189 | 3453 | 4429 |
| CD123 | 1763 | 1513 | 12190 | 3467 | 4443 |
| BST1 | 1908 | 1658 | | 3612 | 4588 |
| FLT3 | 1810 | 1560 | 12194 | 3514 | 4490 |

When control HSCs were incubated with CD33 CAR-T (e.g., SEQ ID NO: 1499, 12189, 3453, 4429) in vitro there is a marked decrease in cell count due to CD33 CAR-T-mediated killing of CD33 positive cell population. In contrast, CD33-AMR expressing HSCs show a significant number of residual cells remaining after CD33 CAR-T treatment. Similarly, expressing of AMR targeting MPL, CD123, BST1 and FLT3 in HSC are shown to protect them against killing by CAR-T cells targeting MPL, CD123, BST1 and FLT3, respectively. The protective effect is also observed in vivo.

More detailed functional evaluation of AMR HSCs is performed in comparison with control HSC in vivo. NSG mice are engrafted with either control or CD33-AMR HSCs. The mice engrafted with either control or CD33-AMR HSCs show normal myeloid development. The CD33-AMR HSCs differentiated into mature myeloid cells (neutrophils and macrophages). Cell morphology is analyzed by cytospin and characteristic cell surface markers (CD1 1b, CD 15, CD 14, CD 16, CD45, CD66b, and HLA-DR) by flow cytometry.

CD33-AMR human CD34+ cells are capable of long-term multi-lineage engraftment. Primary human CD34+ cells are derived from G-CSF mobilized peripheral blood and lead to equivalent number and morphology of hematopoietic myeloid and erythroid colonies. 8-12 week old NSG mice are injected with either control or CD33-AMR CD34+ cells. Twelve weeks later, the percentage of hCD45 in peripheral blood (engraftment) is measured. B cells (CD 19+), CD3+ T cells (CD3+), and non-lymphoid cells are detected with no significant difference between the two groups. Human myeloid cells in CD33-AMR HSPC-engrafted mice have significantly reduced levels of CD33 expression, but no difference is observed in CD1 1b+14+ expression compared to control HSPC-engrafted mice. In addition, bone marrow harvested after 16 weeks shows equal levels of human CD45+ engraftment in control and CD33-AMR HSPC-engrafted mice. There are no significant differences in the levels of human stem cells and myeloid progenitors in the bone marrow of mice engrafted with either control or CD33 AMR HSPCs. Bone marrow is harvested from NSG mice after 16 weeks of primary engraftment then transferred into secondary recipients and analyzed after 12 additional weeks. Sustained human engraftment with persistent CD33-low phenotype is observed. In the bone marrow, no difference in total human engraftment between the CD33-AMR or CD33WT groups is observed, with differentiation into lymphoid and myeloid lineages, with the exception of decreased CD33 expression. At the end of the 16-week primary transplant, expression of CD33 on non-lymphoid human cells indicates protracted, stable absence of CD33 in marrows of xenografted mice.

Example 18: CD33-AMR HSPCs are Resistant to CD33-Targeted Therapy

NSG mice engrafted with control or CD33-AMR HSPCs are given autologous CD33 CAR-T cells, and residual human myeloid cells are assessed after 4 weeks. CD33 are eliminated in the peripheral blood of mice treated with CD33 CAR-T, which leads to ablation of myeloid cells in the control HSPC-engrafted mice, while in the CD33-AMR HSPC-engrafted mice the myeloid cells are sustained. Myeloid cells are detected in the peripheral blood, spleen, and bone marrow of the CD33-AMR HSPC-engrafted mice after CD33 CAR-T treatment, in contrast to the myeloablation seen in control HSPC-engrafted mice. Human progenitor cells are significantly increased in CD33-AMR HSPC-engrafted mice after CD33 CAR-T treatment compared to controls.

Furthermore, it is demonstrated herein that CD33 CAR-T can eradicate AML while sparing CD33-AMR HSPCs. NSG mice are first engrafted with control or CD33-AMR HSPCs, then injected with Molm14, an AML cell line engineered to express green fluorescent protein and luciferase, followed by CD33 CAR-T treatment. AML disease burden is measured by bioluminescent imaging (BLI), while human HSPCs are measured by flow cytometry of the peripheral blood. Both control and CD33-AMR HSPC-engrafted mice go into AML disease remission after CD33 CAR-T treatment. Tumor burden decreased in both control and CD33-AMR HSPC-engrafted mice within 1-2 weeks post-CD33 CAR-T treatment. CD 33-AMR HSPC-engrafted mice show persistent CD 14+ myeloid cells after CD33 CAR-T treatment of AML in the peripheral blood (PB), spleen, and bone marrow (BM), in contrast to controls, Human progenitor cells are spared from CD33 CAR-T-mediated toxicity in the CD33 KO HSPC group only.

Example 19: CD33-AMR Myeloid Cells are Able to Retain Normal Function

Experiments described herein demonstrate that CD33-AMR HSPC progeny have no functional defects. Human cells obtained from HSPC-engrafted mouse bone marrow show characteristic morphologic features of normal stem cell (blast), myeloid progenitor (promyelocyte), and terminal effector cells (monocytes and neutrophils). Control or CD33-AMR HSPCs are differentiated in vitro with myeloid cytokines (SCF, IL-6, FLT3, TPO, GM-CSF, IL-3). No significant differences in phagocytosis percentages is seen between control and CD33-AMR HSPCs.

Essentially similar methods and procedure are used to demonstrate the ability of AMR targeting MPL, CD123, FLT3 and BST-1 to protect HSC in vivo from cytotoxicity of the corresponding CAR-T cells and T cell activating bispecific antibodies.

Essentially similar methods are used to demonstrate the ability of AMR targeting CD19, CD20, CD22, BCMA, CS1, Lym1, Lym2 etc to protect hematopoietic cells in vitro and in vivo from cytotoxicity of the corresponding CAR-T cells and T cell activating bispecific antibodies.

Example 20: Hematopoietic Stem Cell Transplant with MPL-AMR-Expressing HSC and MPL SIR-T Cell Therapy A patient with MPL-expressing Acute Myeloid Leukemia achieves a complete remission as measured by morphology and flow cytometry following induction chemotherapy with 7+3 (Ara-C and Idarubicin). The patient's peripheral blood stem cells are collected by leukapheresis following G-CSF mobilization. The CD34+ hematopoietic stem cells (HSC) are purified using CD34 magnetic beads and transduced with a lentiviral vector expressing an AMR (SEQ ID NO: 1846) targeting MPL using techniques known in the art. The CD3+ T cells from the leukapheresis product are activated with CD3/CD28 beads and then transduced with a lentiviral vector expressing a SIR (e.g., SEQ ID NO: 3550) or a TFP (e.g., SEQ ID NO: 12191) or an Ab-TCR (e.g., SEQ ID NO: 4526) targeting MPL. The T cells are expanded in vitro for 7-10 days in T cells culture medium with CD3/CD28 beads. Subsequently, the patient receives myeloablative high dose chemotherapy followed by infusion of genetically modified MPL-AMR-expressing CD34+ HSC ($5\times10^6$/kg) and MPL-SIR-T cells ($3\times10^6$/kg). Patient demonstrates recovery of blood counts 3 weeks following transplant. The MPL-SIR-T cells can be administered on the same day as HSC. Alternatively, the MPL-SIR-T cells can be administered before (e.g., 1 day, 2 days or 3 days before etc.) or after (e.g., 1 day, 2 days, 3 days after etc.) the administration of HSC. MPL-SIR-T cells can be also administered upon the recovery of blood counts.

Essentially a similar procedure is used to protect HSC from cytotoxicity induced by 2nd generation CAR (e.g., SEQ ID NO: 1596), TFP (e.g., SEQ ID NO:12191) or an Ab-TCR (e.g., SEQ ID NO:4526) and T cell activating bispecific antibodies targeting targeting MPL.

Essentially a similar procedure is used to protect allogeneic HSC from cytotoxicity induced by CARs, e.g., 2nd generation CAR (e.g., SEQ ID NO: 1596), SIR, TFP (e.g., SEQ ID NO:12191), Ab-TCR (e.g., SEQ ID NO:4526) and T cell activating bispecific antibodies targeting targeting MPL. The administration of allogeneic stem cells and CAR-T cells requires Graft vs Host Disease prophylaxis, which is determined by the conditioning regimen, the source of the allograft and the preference of the treating physician.

Essentially a similar procedure can be used to protect HSC from cytotoxicity induced by $2^{nd}$ generation CAR, SIR, TFP, Ab-TCRs and T cell activating bispecific antibodies targeting CD33, CD123, BST-1 and FLT3.

Example 21: Use of AMR-dTAG Fusion Protein to Reversibly Control the Expression of Antigens Hematopoietic stem cells and progenitor cells are infected with lentiviral vector expressing AMR-dTAG fusion protein targeting CD33 (e.g., SEQ ID NO: 2999). Expression of CD33 is masked in the transduced hematopoietic stem cells and progenitor cells. The AMR-dTAG cells are protected from cytotoxicity of CD33 CAR-T cells in vitro. Subsequently, the cells are treated with dTAG13 (100 nM), which results in degradation of AMR fusion protein. The transduced cells are also transplanted into NSG mice along with Molm14 AML leukemia cells. Animals are exposed to CD33 CAR-T cells which results in elimination of the Molm14 AML cells. However, AMR-dTAG expressing HSC and their differentiated progenitors are protected from CD33 CAR-T cell cytotoxicity. After the Molm14 AML cells are eliminated, the animals are treated with dTAG-13 (25 mg/kg) daily which results in the degradation of the AMR-dTAG fusion protein.

Example 22: Use of AMR-ShieldTag Fusion Protein to Reversibly Control the Expression of Antigens Hematopoietic stem cells and progenitor cells are infected with lentiviral vector expressing AMR-ShieldTag fusion protein targeting CD33 (e.g., SEQ ID NO: 3249). Expression of CD33 is masked in the transduced hematopoietic stem cells and progenitor cells in the presence of Shield-1. The CD33 AMR-ShieldTag cells are protected from cytotoxicity of CD33 CAR-T cells in vitro in the presence of Shield-1. Subsequently, Shield-1 treatment is stopped, which results in degradation of AMR fusion protein. The transduced cells are also transplanted into NSG mice along with Molm14 AML leukemia cells. Animals are exposed to CD33 CAR-T cells in the presence of Shield-1 which results in elimination of the Molm14 AML cells. However, CD33 AMR-ShieldTag expressing HSC and their differentiated progenitors are protected from CD33 CAR-T cell cytotoxicity. After the Molm14 AML cells are eliminated, the Shield-1 treatment is stopped which results in the degradation of the CD33 AMR-ShieldTag fusion protein.

Example 23: Use of AMR Targeting CD3, HLA, Beta2 Microglobulin and CD52 in T Cells Allogeneic T cells are collected from leukapheresed blood product from a healthy HLA-A201 donor and purified using CD3 magnetic beads. The T cells are genetically modified by expression of lentiviruses encoding AMRs targeting CD3 (e.g., SEQ ID NO: 1450 or 1946), HLA-A2 (e.g., SEQ ID NO: 1833), beta2M (e.g., SEQ ID NO: 1453 or 1953) and CD52 (SEQ ID NO: 1944). Furthermore, a SIR targeting CD19 (SEQ ID NO: 3705) is expressed in the cell product. T cells lacking the expression of CD3, HLA-A1, and CD52 are purified using magnetic sorting and administered to a subject with CD19-expressing Acute Lymphocytic Leukemia following administration of lymphodepleting chemotherapy. The subject further receives a CD52 monoclonal antibody (e.g., CAMPATH), which depletes the host T cells.

Example 24: Use of AMR Targeting CD3, HLA, Beta2 Microglobulin and CD52 in SIR-T Cells Coexpressing PDL1, PDL2, CD80 and/or CD86

The protocol in the previous example is repeated with the exception that the allogeneic T cells are further modified to express one or more of PDL-1 (SEQ ID NO: 72), PDL-2 (SEQ ID NO: 73), CD80 (SEQ ID NO: 71), CD86 (SEQ ID NO: 79). In some embodiments, the allogeneic T cells are genetically modified to also express MC159 (SEQ ID NO: 76).

Example 25: Use of T Cells Expressing PDL1, PDL2, CD80 and/or CD86 for Adoptive Cell Therapy Allogeneic T cells are collected from leukapheresed blood product from a healthy HLA-A201 donor and purified using CD3 magnetic beads. The T cells are genetically modified by expression of lentiviruses encoding CD19 CARs coexpressing PDL-1 (SEQ ID NO: 3455), PDL-2 (SEQ ID NO: 3456), MC159 (SEQ ID NO: 3456), CrmA (SEQ ID NO: 3457) and/or p35 (SEQ ID NO: 3458). The expression of endogenous TCRα chain and (32M is knocked out using CRISP/Cas9 approach. T cells lacking the expression of TCR/CD3 complex and (32M and expressing the CAR construct are purified using magnetic sorting and administered to a subject with CD19-expressing Acute Lymphocytic Leukemia following administration of lymphodepleting chemotherapy. In some embodiments, the method further involves infusing the recipient with an allogeneic hematopoietic cell composition comprising at least $1\times10^{6}$ CD34+ cells/kg and at least $1.0\times10^{7}$ CD3+ cells/kg derived from the same donor from whose leukapheresed product the CAR-T cell are manufacture, and maintaining the recipient on an immunosuppressive regimen for a period of time sufficient to develop mixed chimerism for at least six months. In one embodiment, the allogeneic CAR-T cell product is infused after the administration of allogeneic hematopoietic cell composition comprising at least $1\times10^{6}$ CD34+ cells/kg and at least $1.0\times10^{7}$ CD3+ cells/kg. In some embodiments, the subject further receives total lymphoid irradiation with or without a CD40L antagonist antibody prior to the administration of the allogeneic CAR-T cell product.

Example 26: Use of Gene Modified Allogeneic CD3+ Cells Along with CD34 Cells in Patients with Adult B Cell Acute Lymphocytic Leukemia An open-label study in adult B-cell ALL patients is performed. Patients receive TLI, rabbit ATG and an infusion of G-CSF "mobilized blood" mononuclear cells that have been enriched for CD34+ cells and contain a defined number of CD34+ and gene modified CAR-T CD3+ donor cells. Immunosuppressive drugs consist of 9 months of mycophenolate mofetil (MMF; 15 mg/Kg twice per day starting on day 10), and a tapering course of daily tacrolimus starting on day 0 that is discontinued at a target of 12 months. The immunosuppressive drug combination consists of a calcineurin inhibitor and a purine metabolism inhibitor.

Recipients in the study are given a target dose of $\geq10\times10^{6}$ CD34+ cells/Kg and an escalating dose of T cells to achieve the target dose of $1\times10^{7}$/Kg T cells from the "mobilized" peripheral blood mononuclear cells harvested from the allogeneic donor.

Study Therapies. During the course of this study, patients receive 5 intravenous injections of rabbit ATG (Thymoglobulin), a total of 1,200 cGy of total lymphoid irradiation, a single infusion of donor cells, transient immunosuppression (MMF and Tacrolimus), and prophylactic anti-viral, antifungal and antibacterial agents.

Patients receive a total of 5 intravenous doses of Thymoglobulin over a 5 day period; each dose is 1.5 mg/kg. The first day of Thymoglobulin administration is counted as Day 1. In some embodiments, a CD52 antibody (e.g., Campath) is substituted for Thymoglobulin.

Patients receive ten treatments of fractionated irradiation (120 cGy each) targeted to the lymph nodes, spleen and thymus gland on days 1 through 4, and days 7 through 11, such that the total dose of TLI is 1,200 cGy. Two doses are given on day 10 or 11 to achieve a total of 10 doses. TLI is given to the inverted Y and mantle fields. During the administration of TLI, patients are monitored for the development of neutropenia (granulocytes <2,000/mL), thrombocytopenia (platelets <60,000/mL) and infection. TLI is withheld for any of these problems, and G-CSF (10 μg/kg/day) is given for neutropenia. TLI is reinstated once neutropenia and/or thrombocytopenia resolves. At the completion of TLI, all patients are given G-CSF (10 μg/kg/day) if the white blood cell count is below 1,000 cells/mm3. TLI is completed by day 11 if no doses are withheld.

A single intravenous infusion of cryopreserved allogeneic donor, G-CSF mobilized blood mononuclear cells (recovered from donor peripheral blood using apheresis), that has been "engineered" is administered to patients on the day of completion of TLI. In an alternate embodiment, the cell product is split into two doses that are given 5-10 days apart. Harvesting of donor cells is performed in the following fashion: The donor is given G-CSF daily (16 mg/kg/day) for five days, and mononuclear cells are harvested by an apheresis of up to 20 liters. In addition, a second session of up to 12 liters may be carried out for optimal cell recovery. Cells are selected for CD34+ cells on CD34 magnetic beads using CLINIMAC Prodigy system. CD34 negative fraction is collected also and purified for T cells using CD3 magnetic beads and CLINIMAC Prodigy system. In some embodiments, the donor is not given G-CSF and only the CD3+ cells are purified. The purified T cells are activated using CD3/CD28 beads and IL2 and infected with lentivirus vector encoding a CD19 targeted CAR plus PDL-1 (e.g., SEQ ID NO: 3455), CAR plus PDL-2 (SEQ ID NO: 3456), CAR plus MC159 (SEQ ID NO: 71), or a combination of the above constructs using methods known in the art. In alternate embodiment, the T cells are infected with lentivirus vector encoding a CD19-targeted CAR (e.g., SEQ ID NO: 1455), SIR (e.g., SEQ ID NO: 3461), Ab-TCR (e.g., SEQ ID NO: 4437) or TFP (e.g., SEQ ID NO: 12185). The gene modified T cells are expanded in culture for 3-4 days with CD3/CD28 beads and IL2. Both CD34+ cells and CD3+ T cells are cryopreserved and thawed according to standard procedures at the USC Blood and Marrow Transplantation laboratory. The target dose of CD34+ cells to be injected is $\geq1\times10^{4}$ to $1\times10^{6}$ cells/kg. A defined target dose of ($1\text{-}3\times10^{6}$/kg CD3+) gene modified T cells is administered along with enriched CD34+ cells intravenously. In some embodiments, only the gene modified CD3+ cells are infused without the CD34+ cells.

Corticosteroid therapy is limited to 60-120 mg Solumedrol (I.V.) as premedication on the days of ATG infusions to reduce ATG side effects. After the last dose of ATG, a tapering course of prednisone starting at 30 mg/d and reducing by 5 mg/d is given until day 10.

MMF therapy is commenced on the day of the donor cell infusion (day 10) at 15 mg/Kg twice per day. MMF therapy is maintained for 6 months at the descrition of the treating physician, and then tapered and stopped at 9 months.

Tacrolimus is started 3 days before the infusion of donor cells, adjusted to achieve a standing whole blood trough level. As long as the criteria for immunosuppressive drug tapering are met, Tacrolimus is tapered beginning at month 9, and stopped by month 12.

If acute or chronic GVHD is observed that would ordinarily be treated with immunosuppressive drugs, then the patient is considered a treatment failure.

Immunosuppressive drugs are administered according to standard practice.

Example 27: Use of IMA Targeting CD19 for the Amelioration and Treatment of CD19 CAR-T Cell Associated Immunological Adverse Reactions A patient with diffuse large B cell lymphoma receives infusion of autologous CD19 CAR-T cells (Yescarta) after lympho-depleting chemotherapy. Three days after infusion, the patient developed signs and symptoms consistent with CRS and CRES, including fever, increased heart rate, fall in systolic blood pressure, elevation of serum C-reactive protein, elevation of serum IL6, mental status alteration and aphasia. There is a greater than 20-fold expansion of CAR-T cells as measured by qPCR in peripheral blood. To ameliorate and treat CRS and CRES, the patient is administered a purified FMC63-scFv IMA (SEQ ID NO: 6591) comprising a single chain variable fragment (scFv) derived from FMC63 antibody by continuous intravenous infusion at an initial rate of 10 μg/m$^2$/day. The rate of infusion is adjusted by the attending physician based on clinical and laboratory parameters, including the level of CAR-T cells in the peripheral blood with the goal to keep the CAR-T cells below 10 cells/W. After improvement in patient's clinical status and laboratory parameters, the rate of infusion is decreased and entirely stopped after 25 days.

In alternate embodiments, essentially a similar procedure is used to ameliorate and treat immunological adverse reactions associated with administration of next generation CAR-T cells, including but not limited to administration of CD19 SIR-T cell (e.g., SEQ ID NO: 9347) or CD19-Ab-TCR (e.g., SEQ ID NO: 10323) or CD19-TFP-T cells etc. The FMC63-scFv (e.g., SEQ ID NO: 6591) and similar IMAs (e.g., SEQ ID NO: 6592, 6595, 6596 and 6597 etc) can be also used to ameliorate and treat immunological adverse reactions associated with administration of CD19×CD3 bispecific antibodies, including bispecific T cell engager (Blinatumomab) and DARTs.

Example 28: Use of IMA Targeting CD19 for the Prevention of CD19 CAR-T Cell Associated Immunological Adverse Reactions A patient with diffuse large B cell lymphoma receives infusion of autologous CD19 CAR-T cells (Yescarta) after lympho-depleting chemotherapy consisting of 30 mg/m$^2$/day i.v. fludarabine plus 500 mg/m$^2$/day cyclophosphamide i.v.×3 days. To prevent CRS and CRES, the patient is administered a purified FMC63-scFv IMA (SEQ ID NO: 6591) comprising a single chain variable fragment (scFv) derived from FMC63 antibody by continuous intravenous infusion at an initial rate of 5 μg/m$^2$/day starting 1 day after the infusion of CAR-T cells. The rate of infusion is adjusted by the attending physician based on clinical and laboratory parameters, including the level of CAR-T cells in the peripheral blood with the goal to keep the CAR-T cells below 10 cells/W. The rate of infusion is decreased gradually starting day 21 and entirely stopped after 25 days.

In alternate embodiments, essentially a similar procedure is used to prevent immunological adverse reactions associated with administration of next generation CAR-T cells, including but not limited to administration of CD19 SIR-T cell or CD19-Ab-TCR or CD19-TFP-T cells etc. The FMC63-scFv IMA and similar IMA (e.g., SEQ ID NO: 6592, 6595, 6596 and 6597 etc) can be also used to prevent immunological adverse reactions associated with administration of CD19×CD3 bispecific antibodies, including bispecific T cell engager (Blinatumomab) and DARTs.

Example 29: Emergency Administration of IMA Targeting CD19 for the Prevention and Early Treatment of CD19 CAR-T Cell Associated Immunological Adverse Reactions A patient with CD19-expressing B cell Acute Lymphocytic Leukemia receives infusion of autologous CD19 CAR-T cells (Kymriah) after lympho-depleting chemotherapy consisting of 30 mg/m$^2$/day i.v. fludarabine plus 500 mg/m$^2$/day cyclophosphamide i.v.×3 days. Patient is discharged home after administration of CAR-T cells with auto-injectors containing 50 μg and 100 μg of FMC63-scFv IMA (SEQ ID NO: 6591) and instructions for administration of the drug in case of fever >38.5° C., or heart rate >120/min or systolic blood pressure <90 mm Hg or alteration in mental status. On day 3 after CAR-T cell infusion, the patient develops symptoms consistent with CRS and altered mental status. After phone consultation with the oncologist, the patient is administered a 50 μg dose of FMC63-scFv by a care-giver on route to the emergency room for further evaluation.

In an alternate embodiment, emergency administration of an IMA (SEQ ID NO: 6595) targeting CD19 using auto-injectors is used for the early prevention and early treatment of immunological adverse reactions associated with the administration of a CD19×CD3 bispecific antibody. In alternate embodiments, emergency administration of an IMA targeting CD3 using auto-injectors is used for the early prevention and early treatment of immunological adverse reactions associated with the administration of CD19 CAR-T cells or a CD19×CD3 bispecific antibody. Finally, IMA targeting any other antigen (e.g., CD20, CD22, BCMA, CD33, CD123, Mesothelin, IL13Ra2 etc) can be similarly administered by patients or care-givers using auto-injectors.

Example 30: Administration of an IMA Targeting CD19 Via an Ommaya Reservoir for the Treatment of CD19 CAR-T Cell Associated CRES and Neurological Toxicity A patient with CD19-expressing B-ALL receives infusion of allogeneic CD19 CAR-T cells after lympho-depleting chemotherapy consisting of 30 mg/m$^2$/day i.v. fludarabine plus 500 mg/m$^2$/day cyclophosphamide i.v.×3 days. On day 7 after CAR-T infusion, the patient develops mental status alterations and seizures. Lumber puncture reveals presence of CAR-T cells in the cerebro-spinal fluid (CSF) and absence of infection. Patient receives Tocilizumab 8 mg/kg i.v. and Dexamethasone 10 mg i.v. without improvement.

Finally, patient receives purified FMC63-scFv IMA (SEQ ID NO:6592) at dose of 1 mg via an ommaya reservoir. The dose is repeated after 3 days.

Example 31: Use of IMA Targeting CD123, MPL, CD33, BCMA, CD20, CD22, CD30, Mesothelin (MSLN) and IL13Ra2 for the Amelioration and Treatment of Immunological Adverse Reactions Associated with the Administration of CAR/SIR/Ab-TCR/TFP and Bispecific Antibodies Targeting the Corresponding Antigens Patients with cancers expressing CD123, MPL, CD33, BCMA, CD20, CD22, FLT3, Mesothelin (MSLN) and IL13Ra2 receive infusion of autologous or allogeneic T cells expressing CAR (e.g., $2^{nd}$ generation CAR, SIR, Ab-TCR, or TFP etc.) targeting the above antigens after lymphodepleting chemotherapy. Three to seven days after infusion, the patients developed signs and symptoms consistent with CRS and CRES, including fever, increased heart rate, fall in systolic blood pressure, elevation of serum C-reactive protein, elevation of serum IL6, mental status alteration and aphasia. There is a greater than 20-fold expansion of genetically modified T cells as measured by qPCR in peripheral blood. To ameliorate and treat CRS and CRES, the patients are administered IMA comprising a single chain variable fragment (scFv) having vL and vH sequences identical to the vL and vH sequences of the antigen binding domains of the corresponding CAR, SIR, Ab-TCR or TFP. The SEQ ID NOs of the CARs, SIR, Ab-TCR constructs and the SEQ ID NOs of the corresponding IMA/scFv that is administered to ameliorate and treat CRS and CRES caused by the above constructs are provided in Table 28. The IMA are administered by continuous intravenous infusion at an initial rate of 10 μg/m$^2$/day. The rate of infusion is adjusted by the attending physician based on clinical and laboratory parameters, including the level of genetically modified T cells in the peripheral blood with the goal to keep the genetically modified T cells below 10 cells/W. After improvement in patient's clinical status and laboratory parameters, the rate of infusion is decreased and entirely stopped after 25 days.

TABLE 28

TARGET ANTIGENS AND SEQ ID Nos OF EXEMPLARY CARs, SIR, AB-TCR TARGETING THOSE ANTIGENS AND THE IMA THAT CAN PROTECT AGAINST THEIR CYTOTOXICITY AND SIDE EFFECTS.

| TARGET ANTIGEN | CAR (SEQ ID NO) | SIR (SEQ ID NO) | Ab-TCR (SEQ ID NO) | IMA/scFv (SEQ ID NO) | IMA/scFv Name |
|---|---|---|---|---|---|
| BCMA | 7356 | 9357 | 10333 | 6606 | BCMA-huC 12A3-L3H3-scFv-His |
| MPL | 7482 | 9436 | 10412 | 6732 | MPL-161-scFv-His |
| CD20 | 7372 | 9511 | 10487 | 6622 | CD20-Ubli-v4-scFv-His |
| CD22 | 7548 | 9565 | 10541 | 6798 | CD22-HA22-scFv-His |
| CD123 | 7399 | 9478 | 10454 | 6649 | CD123-1172-scFv-His |
| CD33 | 7385 | 9373 | 10349 | 6635 | CD33-huMyc9-scFv-His |
| FLT3 | 7552 | 9572 | 10548 | 6802 | FLT3-8B5-scFv-His |
| MSLN | 7570 | 9584 | 10560 | 6820 | MSLN-7D9-v3-scFv-His |
| IL13Ra2 | 7471 | 9425 | 10401 | 6721 | IL13Ra2-hu107-scFv-His |

In alternate embodiments, the IMAs targeting CD123, MPL, CD33, BCMA, CD20, CD22, CD30, Mesothelin (MSLN) and IL13Ra2 are also used to ameliorate and treat immunological adverse reactions associated with administration of bispecific antibodies targeting these antigens.

Example 32: Use of IMA Targeting CD3 for the Prevention of Mosunetuzumab (a Full Length CD20×CD3 Bispecific Antibody) and REGN197-Associated Immunological Adverse Reactions A patient with diffuse large B cell lymphoma receives Mosunetuzumab at dose of 2.4 mg intravenously. Two days after the administration of the drug, patient develops grade 2 CRS. The patient is administered a CD3-scFv IMA (SEQ ID NO: 6836) dissolved in 0.9% normal saline by continuous intravenous infusion at an initial rate of 10 μg/m$^2$/day. In an alternate embodiment, a CD3-scFv having the vL and vH sequences identical to the CD3 binding domain of Mosunetuzumab is used. The rate of infusion is adjusted by the attending physician based on clinical (e.g., heart rate, blood pressure, 02 saturation etc.) and laboratory parameters (e.g., serum CRP, IL6, Creatinine and LDH levels) and peripheral B and T cell counts. The rate of infusion is decreased gradually starting day 7 and entirely stopped after 10 days. The CD3-scFv IMA (SEQ ID NO: 6836) is similarly used to treat CRS caused by REGN1979 another Anti-CD20× Anti-CD3 bispecific antibody. In an alternate embodiment, a CD3-scFv having the vL and vH sequences identical to the vL and vH sequences comprising the CD3 binding domain of REGN1979 are used. Finally, in an alternate embodiment, a CD3-scFv IMA (e.g., SEQ ID NO: 6832 or 6836) is used to prevent immunological adverse events associated with administration of T cell activating bispecific antibodies, such as Mosunetuzumabm, REGN197, CD20-TCB, AMG 701, AMG 330, AMG 673, AMG 575, AMG 424, AMG 427 and AMG 562.

Example 33: Use of IMA Targeting CD20 for the Prevention of Mosunetuzumab (a Full Length CD20×CD3 Bispecific Antibody) and CD20-TCB (RG6026)-Associated Immunological Adverse Reactions A patient with diffuse large B cell lymphoma receives Mosunetuzumab at dose of 2.4 mg intravenously. Two days after the administration of the drug, patient develops grade 2 CRS. The patient is administered a CD20-scFv (SEQ ID NO: 6620) comprising the CD20 binding domain of Mosunetuzumab dissolved in 0.9% normal saline by continuous intravenous infusion at an initial rate of 10 μg/m$^2$/day. The rate of infusion is adjusted by the attending physician based on clinical and laboratory parameters. The rate of infusion is decreased gradually starting day 7 and entirely stopped after 10 days.

A CD20-scFv IMA is similarly used to treat CRS caused by REGN1979 another Anti-CD20× Anti-CD3 bispecific antibody. The CD20-scFv has the vL and vH sequences identical to the vL and vH sequences comprising the CD20 binding domain of REGN1979.

A CD20-scFv IMA is similarly used to treat CRS caused by CD20-TCB (RG6026) another Anti-CD20× Anti-CD3 bispecific antibody. The CD20-scFv has the vL and vH sequences identical to the vL and vH sequences comprising the CD20 binding domain of CD20-TCB (RG6026). In an alternate embodiment, any of the CD20 targeted scFv listed in Table 6 can be used to prevent and ameliorate the side effects of CD20×CD3 bispecific antibodies (e.g., REGN1979 and Mosunetuzumab) if they can compete with the CD20×CD3 bispecific antibodies for binding to CD20.

Example 34: Use of IMA Targeting BCMA for the Prevention of AMG 420 and AMG 701-Associated Immunological Adverse Reactions A patient with multiple myeloma receives AMG 420 at dose of 400 μg/d by continuous iv infusion. Two days after the start of the administration of the drug, patient develops grade 2 CRS. The patient is administered a BMCA-scFv comprising the BCMA binding domain of AMG 420 dissolved in 0.9% normal saline by continuous intravenous infusion at an initial rate of 10 μg/m$^2$/day. The rate of infusion is adjusted by the attending physician based on clinical and laboratory parameters. The rate of infusion is decreased gradually starting day 7 and entirely stopped after 10 days.

A BCMA-scFv IMA is similarly used to treat CRS caused by AMG 701 another BCMA×Anti-CD3 bispecific antibody. This BCMA-scFv IMA has the vL and vH sequences identical to the vL and vH sequences comprising the BCMA binding domain of AMG 701.

In an alternate embodiment, any of the BCMA targeted scFv listed in Table 6 can be used to prevent and ameliorate the side effects of BCMA×CD3 bispecific antibodies if they can compete with the BCMA×CD3 bispecific antibodies for binding to BCMA.

Example 35: Use of IMA Targeting CD33 for the Prevention of AMG 330- and AMG 673-Associated Immunological Adverse Reactions A patient with Acute Myeloid Leukemia receives AMG 330 at dose of 20 μg/d by continuous iv infusion. Two days after the start of the administration of the drug, patient develops grade 2 CRS. The patient is administered a CD33-scFv comprising the CD33 binding domain of AMG 330 dissolved in 0.9% normal saline by continuous intravenous infusion at an initial rate of 10 μg/m$^2$/day. The rate of infusion is adjusted by the attending physician based on clinical and laboratory parameters. The rate of infusion is decreased gradually starting day 7 and entirely stopped after 10 days.

A patient with Acute Myeloid Leukemia receives AMG 673. Two days after the start of the administration of the drug, patient develops grade 2 CRS. The patient is administered a CD33-scFv comprising the CD33 binding domain of AMG 673 dissolved in 0.9% normal saline by continuous intravenous infusion at an initial rate of 10 μg/m$^2$/day. The rate of infusion is adjusted by the attending physician based on clinical and laboratory parameters. The rate of infusion is decreased gradually starting day 7 and entirely stopped after 10 days.

Example 36: Use of IMA Targeting DLL3 for the Prevention of AMG 757-Associated Immunological Adverse Reactions A patient with small cell lung cancer receives AMG 757. Two days after the start of the administration of the drug, patient develops grade 2 CRS. The patient is administered a DLL3-scFv comprising the DLL3 binding domain of AMG 757 dissolved in 0.9% normal saline by continuous intravenous infusion at an initial rate of 10 μg/m$^2$/day. The rate of infusion is adjusted by the attending physician based on clinical and laboratory parameters. The rate of infusion is decreased gradually starting day 7 and entirely stopped after 10 days.

Example 37: Use of IMA Targeting CD38 for the Prevention of AMG 424-Associated Immunological Adverse Reactions A patient with myeloma receives AMG 424. Two days after the start of the drug administration of the drug, patient develops grade 2 CRS. The patient is administered a CD38-scFv comprising the CD38 binding domain of AMG 424 dissolved in 0.9% normal saline by continuous intravenous infusion at an initial rate of 10 μg/m$^2$/day. The rate of infusion is adjusted by the attending physician based on clinical and laboratory parameters. The rate of infusion is decreased gradually starting day 7 and entirely stopped after 10 days.

Example 38: Use of IMA Targeting CD19 for the Prevention of AMG 562 Associated Immunological Adverse Reactions A patient with lymphoma receives AMG 562. Two days after the start of the administration of the drug, patient develops grade 2 CRS. The patient is administered a CD19-scFv comprising the CD19 binding domain of AMG 562 dissolved in 0.9% normal saline by continuous intravenous infusion at an initial rate of 10 μg/m$^2$/day. The rate of infusion is adjusted by the attending physician based on clinical and laboratory parameters. The rate of infusion is decreased gradually starting day 7 and entirely stopped after 10 days.

Example 39: Use of IMA Targeting FLT3 for the Prevention of AMG 427 Associated Immunological Adverse Reactions A patient with AML receives AMG 427. Two days after the start of the administration of the drug, patient develops grade 2 CRS. The patient is administered a FLT3-scFv comprising the FLT3 binding domain of AMG 427 dissolved in 0.9% normal saline by continuous intravenous infusion at an initial rate of 10 μg/m$^2$/day. The rate of infusion is adjusted by the attending physician based on clinical and laboratory parameters. The rate of infusion is decreased gradually starting day 7 and entirely stopped after 10 days.

Example 40: Use of IMA Targeting EGFRvIII for the Prevention of AMG 596 Associated Immunological Adverse Reactions A patient with AML receives AMG 596. Two days after the start of the administration of the drug, patient develops grade 2 CRS. The patient is administered a EGFRvIII-scFv comprising the EGFRvIII binding domain of AMG 596 dissolved in 0.9% normal saline by continuous intravenous infusion at an initial rate of 10 μg/m$^2$/day. The rate of infusion is adjusted by the attending physician based on clinical and laboratory parameters. The rate of infusion is decreased gradually starting day 7 and entirely stopped after 10 days.

Example 41: Use of IMA Targeting CD33 for the Prevention of COVA4231-Associated Immunological Adverse Reactions A patient with Acute Myeloid Leukemia receives COVA4231, a CD3/CD33 bispecific FynomAb. Two days after the start of the administration of the drug, patient develops grade 2 CRS. The patient is administered a CD33-specific Fynomer (D5) comprising the CD33 binding domain of COVA4231 dissolved in 0.9% normal saline by continuous intravenous infusion at an initial rate of 10 μg/$m^2$/day. The rate of infusion is adjusted by the attending physician based on clinical and laboratory parameters. The rate of infusion is decreased gradually starting day 7 and entirely stopped after 10 days.

Example 42: Use of IMA Targeting CEA for the Prevention of Cibisatamab (CEA×CD3)-Associated Immunological Adverse Reactions A patient with colon cancer receives Cibisatamab at dose of 2.4 mg intravenously. Two days after the administration of the drug, patient develops grade 2 CRS. The patient is administered a CEA-scFv comprising the CEA binding domain of Cibisatamab dissolved in 0.9% normal saline by continuous intravenous infusion at an initial rate of 10 μg/$m^2$/day. The rate of infusion is adjusted by the attending physician based on clinical and laboratory parameters. The rate of infusion is decreased gradually starting day 7 and entirely stopped after 10 days.

Example 43: Use of C5-Inhibitor Eculizumab in the Prevention and Treatment of Immune Effector Cell Therapy Associated Neurological Complications A 70 year old male patient with myelofibroris receives haploidentical peripheral blood stem cell transplant using his son as a donor. The patient receives reduced intensity conditioning with Melphalan (100 mg/m2 on day −6), Fludarabine (25 mg/m2×4 on days −5 to −2) and total body irradiation (TBI) of 200 cGy on day −1. Following infusion of haploidentical stem cells on Day 0, the patient receives post-transplant Cyclophosphamide 50 mg/kg×2 on days+3 and +4 and intravenous hydration with normal saline at rate of 250 ml/h for 24 hours after the completion of cyclophosphamide. Patient develops cytokine release syndrome and neurological complications after infusion of stem cells which are manifested by worsening renal function, oliguria, hypotension, fever, tachycardia, tachypnea, increased oxygen requirement and altered mental status. Patient is administered intravenous fluids and supplement oxygene without significant improvement. Patient is then administered Tocilizumab (600 mg i.v.) on day 5 after transplantation with stabilization of blood pressure. However, patient continues to have neurological deterioration with worsening mental status and confusion. Subsequently, the patient is administered Ecoluzimab at the recommended dose (900 mg intravenously) on day 6 after stem cell transplant with gradual improvement in mental function. The dose of Ecoluzimab is repeated at weekly interval depending on the discretion of the physician.

Example 44: Use of C5-Inhibitor Eculizumab in the Prevention and Treatment of CAR-T Associated Neurological Complications and CRES (CAR T Cell Related Encephalopathy Syndrome (CRES)

A 50 years old male patient with B-cell lymphocytic leukemia receives a commercial CD19 CAR-T product (Yescarta) following lymphodepleting chemotherapy with fludarabine and cyclophosphamide based on the recommendations of the manufacturer. The patient develops neurological complications and CRES after infusion of CAR-T product which is manifested by confusion, aphasia, delirium and altered mental status. The patient is administered Ecoluzimab at the recommended dose (900 mg intravenously) with subsequent doses every two weeks with gradual improvement in mental function.

Example 45: Use of C5-Inhibitor Ravulizumab (ALXN1210) in the Prevention and Treatment of CAR-T Associated Neurological Complications and CRES (CAR T Cell Related Encephalopathy Syndrome (CRES)

A 50 years old male patient with B-cell lymphocytic leukemia receives a commercial CD19 CAR-T product (Yescarta) following lymphodepleting chemotherapy with fludarabine and cyclophosphamide based on the recommendations of the manufacturer. The patient develops neurological complications and CRES after infusion of CAR-T product which are manifested by confusion, tremors, aphasia, delirium and altered mental status. The patient is administered Ravulizumab at the recommended dose (3000 mg i.v.) with gradual improvement in mental function.

Example 46: Use of IMA Targeting NKp46 for the Prevention of IPH61-Associated Immunological Adverse Reactions A patient with cancer receives IPH61. Two days after the administration of the drug, patient develops grade 2 CRS. The patient is administered a NKp46-scFv comprising the NKp46 binding domain of IPH61 dissolved in 0.9% normal saline by continuous intravenous infusion at an initial rate of 10 μg/m2/day. The rate of infusion is adjusted by the attending physician based on clinical and laboratory parameters. The rate of infusion is decreased gradually starting day 7 and entirely stopped after 10 days.

Example 47: Use of Anti-C5 Antibody Tesidolumab in CRES and/or CRS

In order to determine the effect of the anti-C5 antibody tesidolumab in patients with CRES and CRS, a randomized, standard of care (SoC)-controlled, open-label, multi-center study us designed. The study group are patients with CRS and/or CRES after CAR-T or Bispecific T cell engager therapies.

Approximately 40 patients are randomized to receive standard of care treatment (SoC) (including but not limited to steroids and tociluzimab) or tesidolumab plus SoC. Patients are included in the study if they have diagnosis of CRS and/or CRES.

Patients randomized to tesidolumab receive 20 mg/kg body weight on study days 1, 8, and 15, followed by weekly doses of 10 mg/kg for remaining treatment duration of total 16 weeks. In case of inadequate suppression of serum complement activity (CH50 assay below LLoQ) after 10 mg/kg dose, it is possible to change back to 20 mg/kg weekly injection until the end of treatment.

All patients receive prophylactic doses of antibiotics active against *N. meningitidis* during the entire treatment period and 4 weeks after the last treatment. The choice of antibiotic medication is as per hospital standard.

The primary endpoint assessment is done at week 17 (i.e. 1 week after last dose on week 16).

Example 48: Use of tBCMA to Monintor Expression of CAR/SIR and as a Therapeutic Control to Eliminate SIR-T Cells T cells are infected with a lentiviral vector encoding a SIR targeting CD19 (SEQ ID NO: 3461) and coexpressing CD8SP-tBCMA (SEQ ID NO: 68) or GMCSF-SP-Q-tBCMA (SEQ ID NO: 69). The expression of the tBCMA on the transduced is detected by binding with the 293FT supernatant collected 48 hours after the transfection of the fusion construct CD8SP-BCMA-huC12A3-L3H3-(vL-vH)-GGSG-NLuc-4×FLAG-x2STREP-8×His (SEQ ID NO: 192). SIR-T cells are bound with 100 μl of supernatant containing the secreted BCMA-NLuc fusion protein and after 2 washes the NLuc activity is measured by addition of coelentrzine. Robust expression of tBCMA is observed on the SIR-T cells as compared to control T cells as measured by increase in NLuc activity. The SIR-T cells are purified by immunostaining with a FITC-conjugated anti-human BCMA antibody and flow-sorting or by magnetic sorting using BCMA-antibody conjugated magnetic beads. Next, SIR-T cells co-expressing tBCMA are treated with GSK2857916, a BCMA-antibody drug conjugate at concentrations ranging from 0.1 ng/ml to 1 μg/ml. A dose-dependent increase in killing of SIR-T cells coexpressing tBCMA is observed upon treatment with increasing doses of GSK2857916, thereby demonstrating that tBCMA can not only be used to detect and isolate SIR-T cells but also as a therapeutic control to eliminate SIR-T cells in case of side effects in the patients.

Example 49: Use of CD8SP-BCMA-ECD-GGSG-NLuc-4×Flag-2×Streptag-8×His Fusion Protein for Detection of BCMA CAR-T Cells T cells are activated using CD3/CD28 beads and infected with lentiviral vectors encoding BCMA specific CAR (SEQ ID NO: 1470), TFP (SEQ ID NO: 12186), SIR (SEQ ID NO: 3715) and Ab-TCR (SEQ ID NO: 4447). Forty-eight hours post-infection, the expression of BCMA specific CAR, SIR, TFP and Ab-TCR on the surface of T cells is detected using Topanga assay. For this purpose, 293FT supernatant containing secreted NLuc fusion protein collected 72 hours after transfection with the construct CD8SP-BCMA-ECD-GGSG-NLuc-4×Flag-2×Streptag-8×His (SEQ ID NO: 180) is bound to the lentiviral transduced T cells for 45 minutes on ice. Cells are washed twice with PBS and the bound NLuc activity is measured by addition of coelentrazine containing assay buffer. A significant increase in NLuc activity is observed with T cells expressing all BCMA specific CAR, TFP, Ab-TCR and SIR constructs as compared to the control T cells or T cells expressing a CD19-specific CAR. These results demonstrate high expression of secreted BCMA-NLuc fusion protein when generated using a construct containing an N-terminal signal peptide. Essentially similar results are obtained when the CD8 signal peptide (CD8SP; SEQ ID NO: 15)) in the CD8SP-BCMA-ECD-GGSG-NLuc-4×Flag-2×Streptag-8×His construct (SEQ ID NO: 180) is replaced by GM-CSF signal peptide (SEQ ID NO: 14).

All publications and patents mentioned in the above specification are herein incorporated by reference. Various modifications and variations of the described method and system of the disclosure will be apparent to those skilled in the art without departing from the scope and spirit of the disclosure. Although the disclosure has been described in connection with specific embodiments, it should be understood that the disclosure as claimed should not be unduly limited to such specific embodiments. Indeed, various modifications of the described modes for carrying out the disclosure that are obvious to those skilled relevant fields are intended to be within the scope of the following claims.

SEQUENCE LISTING (12237 sequences)

SEQ ID NO: 1 - DNA, 7488 bp, Artificial Sequence
  Synthetic Polynucleotide
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 2 - DNA, 6887 bp, Artificial Sequence
  Synthetic Polynucleotide
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3 - DNA, 7172 bp, Artificial Sequence
  Synthetic Polynucleotide
cccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccggggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagctaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgggaattagcttgatcgattagtccaatttgttaaagacaggatatcagtggtccaggctctagttttgactcaacaatatcaccagctgaagcctatagagtacgagccatagatagaataaaagattttatttagtctccagaaaaaggggggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgatctagatctcgaatcgaattcgtcgactgatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggatcaaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggttt

SEQ ID NO: 4 - DNA, 7181 bp, Artificial Sequence
  Synthetic Polynucleotide
cccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccggggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagctaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgggaattagcttgatcgattagtccaatttgttaaagacaggatatcagtggtccaggctctagttttgactcaacaatatcaccagctgaagcctatagagtacgagccatagatagaataaaagattttatttagtctccagaaaaaggggggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgatctagatctcgaatcgaattcgccgctagcgtcgactgatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggatcaaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggttt

SEQ ID NO: 5 - DNA, 9680 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcaccatggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 6 - DNA, 9649 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctagttaagcttgatatcgaattcctgcagcccgggggatctgctagcaccatgccacctcctcgcctcctcttcttcctcctcttcctcacccccatggaagtcaggcccgactacaaggacgacgatgacaaggaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctggacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 7 - DNA, 7476 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccatggaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagaccgatttctacgactacaaggacgacgatgacaaggattataaagatgatgacgataaagtcgagaccgatttctacgactacaaggacgacgatgacaagtagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 8 - DNA, 8663 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctagttaagcttgatatcgaattcctgcagcccgggggatctgctagcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccactagtggctccggcgagggcagaggaagtctactaacctgcggagatgtggaagaaaatcctggcccacatatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaactcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 9 - DNA, 7524 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgtatcctccctttatccagccctcactccttctctaggcgccggaattagatccccaccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcttaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatcccgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggtgatctgactgatcccgcagattggagatcgccgcccgtgcctgccgattgggtgcagatccgtcgacctgcagccaagcttatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaagggggga

SEQ ID NO: 10 - DNA, 7476 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacgactacaaggacgacgatgacaagtagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 11 - DNA, 226 bp, Artificial Sequence
  Synthetic Polynucleotide
ccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatgg

SEQ ID NO: 12 - DNA, 418 bp, Artificial Sequence
  Synthetic Polynucleotide
aattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcct

SEQ ID NO: 13 - DNA, 5172 bp, Artificial Sequence
  Synthetic Polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14 - DNA, 63 bp, Artificial Sequence
  Synthetic Polynucleotide
atgctgctgctggtcacatctctgctgctgtgcgagctgccccatcctgcctttctgctgatt

SEQ ID NO: 15 - DNA, 63 bp, Artificial Sequence
  Synthetic Polynucleotide
atggccttaccagtgaccgccttgctcctgccgctggccttgctgctccacgccgccaggccg

SEQ ID NO: 16 - DNA, 63 bp, Artificial Sequence
  Synthetic Polynucleotide
atggccctgcccgtgacagccctgctgctgcctctggctctgctgctgcacgccgccagaccc

SEQ ID NO: 17 - DNA, 63 bp, Artificial Sequence
  Synthetic Polynucleotide
atggcccttccagtcactgccttgctgttgcctctggcgctcctgctccacgccgctagaccg

SEQ ID NO: 18 - DNA, 57 bp, Artificial Sequence
  Synthetic Polynucleotide
atggattggatatggaggatactttttctcgtgggggcagcaaccggggctcattcc

SEQ ID NO: 19 - DNA, 57 bp, Artificial Sequence
  Synthetic Polynucleotide
atggactggatttggcgcatccttttccttgtcggcgctgctaccggcgcgcattcc

SEQ ID NO: 20 - DNA, 45 bp, Artificial Sequence
  Synthetic Polynucleotide
ggcggaggcggaagtggaggcggaggatctggcggcggaggctct

SEQ ID NO: 21 - DNA, 105 bp, Artificial Sequence
  Synthetic Polynucleotide
ggaggaggcggctccgggggaggcggaagtggaggcggaggatctgggtctggaggaagcggatctggaggctcagggtcagggggctcaggcagtggaggctct

SEQ ID NO: 22 - DNA, 36 bp, Artificial Sequence
  Synthetic Polynucleotide
gagcagaaactgatctcggaagaggatgggagcggc

SEQ ID NO: 23 - DNA, 36 bp, Artificial Sequence; identical to SEQ ID NO: 22
  Synthetic Polynucleotide

SEQ ID NO: 24 - DNA, 39 bp, Artificial Sequence
  Synthetic Polynucleotide
gagcagaaactgatctcggaagaggatctggggagcggc

SEQ ID NO: 25 - DNA, 39 bp, Artificial Sequence
  Synthetic Polynucleotide
gaacagaaattgataagtgaggaagacttgggcagcggc

SEQ ID NO: 26 - DNA, 39 bp, Artificial Sequence; identical to SEQ ID NO: 24
  Synthetic Polynucleotide

SEQ ID NO: 27 - DNA, 51 bp, Artificial Sequence
  Synthetic Polynucleotide
gggaaaccaattcccaaccctcttctgggactggattcaaccggcagcggc

SEQ ID NO: 28 - DNA, 36 bp, Artificial Sequence
  Synthetic Polynucleotide
tacccctacgatgtgcccgattacgctggcagcggc

SEQ ID NO: 29 - DNA, 27 bp, Artificial Sequence
  Synthetic Polynucleotide
caccatcatcaccatcacggcagcggc

SEQ ID NO: 30 - DNA, 45 bp, Artificial Sequence
  Synthetic Polynucleotide
ggcctgaacgacatcttcgaggctcagaagatcgaatggcacgag

SEQ ID NO: 31 - DNA, 39 bp, Artificial Sequence
  Synthetic Polynucleotide
gggtctggaggcggaggcagcggcggaggcgggagcggc

SEQ ID NO: 32 - DNA, 39 bp, Artificial Sequence
  Synthetic Polynucleotide
ggcagcggcggaggcggaagtggaggcggaggcagcggc

SEQ ID NO: 33 - DNA, 33 bp, Artificial Sequence
  Synthetic Polynucleotide
tggtctcatccccagtttgaaaagggcagcggc

SEQ ID NO: 34 - DNA, 33 bp, Artificial Sequence
  Synthetic Polynucleotide
tggtcccatccccagttcgagaaaggcagcggc

SEQ ID NO: 35 - DNA, 34 bp, Artificial Sequence
  Synthetic Polynucleotide
gattataaagatgatgacgataaagggcagcggc

SEQ ID NO: 36 - DNA, 36 bp, Artificial Sequence
  Synthetic Polynucleotide
gagctgcctacacagggcaccttcagcaacgtgtcc

SEQ ID NO: 37 - skipped

SEQ ID NO: 38 - DNA, 318 bp, Artificial Sequence
  Synthetic Polynucleotide
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagc

SEQ ID NO: 39 - DNA, 309 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgt

SEQ ID NO: 40 - DNA, 303 bp, Artificial Sequence
  Synthetic Polynucleotide
gcctcaacgaaagggcctagcgtcttccccctggcgccgtgctcacgatccacaagcgaatccaccgccgctctcggatgcctcgtaaaggattatttccctgaaccagtcacggtgtcatggaacagcggtgcccttaccagcggcgtccatacctttcctgctgtgctccagtccagcggactttatagtctcagctctgtcgtgaccgtcccttcctctaattttggcacccagacttacacgtgcaacgtcgatcataagcccagtaacaccaaggtagacaagacggtggaacgaaag

SEQ ID NO: 41 - DNA, 306 bp, Artificial Sequence
  Synthetic Polynucleotide
gcctccacgaagggaccatctgttttccctcttgccccctgctcacggtcaacgtctgaatccacggcagccctgggctgcctcgttaaggactactttccagagccggtaacagtctcctggaacagtggagcccttacatcaggtgttcacactttccctgccgtcttgcaaagtagcggactgtacagccttagttccgttgttacggttccttctagcaacttcggtacacagacatatacttgtaacgtagatcataagcctagcaacaccaaggtggacaaaaccgtagagagaaagtgt

SEQ ID NO: 42 - DNA, 309 bp, Artificial Sequence
  Synthetic Polynucleotide
gcaagtacaaagggacccagtgttttcccgctcgccccctgttcacgatcaacgagtgagtccactgcggctctcggatgcctcgtcaaagactacttccccgagccggtgactgttagttggaactctggggctcttacttcaggcgtacacacattccccgccgtgcttcagtcaagtgggctctactcacttagcagtgtggtaacggttccctctagcaactttggcacccaaacatatacttgcaacgtcgatcacaagccgtcaaataccaaagttgacaagaccgttgaaaggaaatgttgt

SEQ ID NO: 43 - DNA, 309 bp, Artificial Sequence
  Synthetic Polynucleotide
gcgtccactaagggtccgtcagtcttcccgctggcgccctgttcccgcagcacgagtgaatctaccgccgcccttgggtgcttggtaaaagactattttcctgagcccgttacagtatcatggaacagcggggctctgactagcggggtgcatacgttccctgcggttctgcaatctagcggactgtattctctctccagtgttgtgaccgtgccaagctccagcctcggtactaaaacttatacatgtaatgtggatcataaaccttcaaataccaaggttgacaaaagggtagagagtaagtacggt

SEQ ID NO: 44 - DNA, 363 bp, Artificial Sequence
  Synthetic Polynucleotide
gcgtctcccacttctccgaaagttttccccctttccctctgtagcacacaacctgatggaaatgtggtcatcgcatgtctggtacaaggattctttccacaagagccattgagcgttacatggtcagagagcgggcagggagttaccgctaggaatttcccaccctcacaggatgcgagtggtgatctttataccacatcatcacaactcacgttgccagccactcagtgcctcgctggaaagtcagtaacatgccatgtcaaacattacactaatccctcacaagatgttaccgtgccttgcccagtaccttctacgccgcccaccccgtctccatctactccacccacgccatcacctagt

SEQ ID NO: 45 - DNA, 324 bp, Artificial Sequence
  Synthetic Polynucleotide
gcgtcacctacgtccccaaaagtgttcccgctgtcactcgattccactccacaggacggtaacgtggtggttgcctgcctggtacaaggtttctttcctcaagaaccactctctgtgacgtggtctgaaagtggtcagaatgttacagcacggaacttcccaccgagtcaagatgcgagtggggatctctatacgacatccagtcaactcacactgcccgcaacacaatgccccgatggcaaatctgttacctgccatgtgaaacattacaccaatccatcccaggatgtgacagtaccttgtccggttccgccccctcccccg

SEQ ID NO: 46 - DNA, 477 bp, Artificial Sequence
  Synthetic Polynucleotide
gctccgacaaaggcgccagacgtttttcctattatttcaggatgtcggcatccgaaagataattccccagttgttctggcgtgtcttatcacgggctaccatcctacatctgttaccgttacgtggtatatgggtacgcaaagccaacctcagcggacttttccagagatccaacggcgagattcatattatatgacatccagtcagttgagtacaccgctgcaacagtggcggcaaggtgagtataagtgtgtggtccaacacacagccagtaaaagtaagaaagagatattccggtggcctgaaagcccgaaggcacaagcatcttctgttccgacggcgcaaccgcaagctgaaggaagtcttgcaaaagcaaccacagcacccgcgacaacacgaaacacaggacgcggaggcgaggaaaagaaaaaagaaaaggaaaaggaagagcaagaggagagggaaactaagaccccc

SEQ ID NO: 47 - DNA, 309 bp, Artificial Sequence
  Synthetic Polynucleotide
gctagtacccagtcaccttctgttttcccgcttactagatgctgcaagaacataccatccaatgccacttctgtcacactgggctgtcttgctacaggttattttcctgagccggtgatggtcacttgggataccggtagcctgaatggaactacaatgacgctgcctgccacgacgctcacattgagtgggcattacgcgacaattagtcttttgacggtaagcggagcttgggctaagcagatgttcacttgcagagtagcgcacactccctctagtactgactgggttgacaacaaaaccttttct

SEQ ID NO: 48 - DNA, 312 bp, Artificial Sequence
  Synthetic Polynucleotide
gggtcagcaagtgcgcccacgctctttccattggtttcttgcgagaactctccctcagacacatcaagtgtcgcggtaggctgtctcgcccaagattttttgcccgatagtataacgctgtcatggaaatataagaacaatagtgatataagctccacaaggggttttccgagcgtactgcgaggcggtaaatatgcagcgacgagtcaagtcttgctcccatccaaggatgtcatgcaaggcaccgatgagcatgttgtttgcaaagtgcaacatccgaatggaaataaggaaaaaaacgtcccgctgccc

SEQ ID NO: 49 - DNA, 66 bp, Artificial Sequence
  Synthetic Polynucleotide
gtgaagcagaccctgaatttcgacctgctgaagctggctggcgacgtggaatccaacccaggccct

SEQ ID NO: 50 - DNA, 54 bp, Artificial Sequence
  Synthetic Polynucleotide
gagggcagaggaagtctactaacctgcggagatgtggaagaaaatcctggccca

SEQ ID NO: 51 - DNA, 57 bp, Artificial Sequence
  Synthetic Polynucleotide
gcaacaaacttctcactactcaaacaagcaggtgacgtggaggagaatcccgggcct

SEQ ID NO: 52 - DNA, 57 bp, Artificial Sequence
  Synthetic Polynucleotide
gcaacaaacttctcactactcaaacaagcaggtgacgtggagcagaatcccgggcct

SEQ ID NO: 53 - DNA, 57 bp, Artificial Sequence
  Synthetic Polynucleotide
gcaaccaacttttctctgctcaagcaagccggtgacgtggaagagaaccctggtcct

SEQ ID NO: 54 - DNA, 60 bp, Artificial Sequence
  Synthetic Polynucleotide
caatgcactaattacgcattgctcaagctggccggtgacgttgagagtaatcctggcccc

SEQ ID NO: 55 - DNA, 12 bp, Artificial Sequence
  Synthetic Polynucleotide
tctggatctgga

SEQ ID NO: 56 - DNA, 12 bp, Artificial Sequence
  Synthetic Polynucleotide
agcggatctggc

SEQ ID NO: 57 - DNA, 12 bp, Artificial Sequence
  Synthetic Polynucleotide
cgggccaagaga

SEQ ID NO: 58 - DNA, 634 bp, Artificial Sequence
  Synthetic Polynucleotide
ggccgcggtaacaattgttaactaacttaagctagcaacggtttccctctagcgggatcaattccgccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgataataccatg

SEQ ID NO: 59 - DNA, 1674 bp, Artificial Sequence
  Synthetic Polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggcagggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtga

SEQ ID NO: 60 - DNA, 1095 bp, Artificial Sequence
  Synthetic Polynucleotide
aaagaggaaacccccgagacacccgaaaccgacagcgaggaagaagtgaccatcaaggccaacctgatcttcgccaacggcagcacccagaccgccgagttcaagggcaccttcgagaaggccaccagcgaagcctacgcctacgccgacaccctgaagaaggacaacggcgagtacaccgtggacgtggccgacaagggctacacactgaacatcaagttcgccggcaaagaaaagacccccgaggaacccaaagaagaagtgactattaaggctaatctgatctacgctgacggcaagacacagacagctgagtttaaggggacattcgaagaagccaccgccgaggcttacagatacgccgatgccctgaaaaaagataatggggagtatacagtggatgtggctgataagggatataccctgaatattaagtttgctgggaaagagaaaacacctgaagaacctaaagaagaagtgacaatcaaagcaaacctgatctatgccgatggaaagacccagactgctgagttcaaaggcacttttgaagaggccactgccgaagcctatcgctatgctgacctgctggctaaagagaacggaaagtacactgtggatgtggcagacaaagggtatactctgaatatcaaattcgccggaaaagagaaaactccagaggaacccaaagaagaagtgaccatcaaagccaatctgatctacgcagatgggaaaactcagaccgcagagtttaaagggactttcgccgaggccacagctgaggcatatagatatgccgatctgctggcaaaagaaaatggcaagtataccgccgacctggaagatggcggctacaccatcaacatccgcttcgccgggaagaaggtggacgagaagcccgaagagaaagaacaagtgactatcaaagagaacatctacttcgaggacggcaccgtgcagaccgccacctttaagggaacctttgccgaggctaccgcagaagcctatagatacgcagacctgctgtccaaagagcatgggaagtatactgctgatctggaagatggggggtatacaatcaatatcagatttgccggc

SEQ ID NO: 61 - DNA, 1092 bp, Artificial Sequence
  Synthetic Polynucleotide
aaagaggaaacccccgagacacccgaaaccgacagcgaggaagaagtgaccatcaaggccaacctgatcttcgccaacggcagcacccagaccgccgagttcaagggcaccttcgagaaggccaccagcgaagcctacgcctacgccgacaccctgaagaaggacaacggcgagtacaccgtggacgtggccgacaagggctacacactgaacatcaagttcgccggcaaagaaaagacccccgaggaacccaaagaagaagtgactattaaggctaatctgatctacgctgacggcaagacacagacagctgagtttaaggggacattcgaagccaccgccgaggcttacagatacgccgatgccctgaaaaaagataatggggagtatacagtggatgtggctgataagggatataccctgaatattaagtttgctgggaaagagaaaacacctgaagaacctaaagaagaagtgacaatcaaagcaaacctgatctatgccgatggaaagacccagactgctgagttcaaaggcacttttgaagaggccactgccgaagcctatcgctatgctgacctgctggctaaagagaacggaaagtacactgtggatgtggcagacaaagggtatactctgaatatcaaattcgccggaaaagagaaaactccagaggaacccaaagaagaagtgaccatcaaagccaatctgatctacgcagatgggaaaactcagaccgcagagtttaaagggactttcgccgaggccacagctgaggcatatagatatgccgatctgctggcaaaagaaaatggcaagtataccgccgacctggaagatggcggctacaccatcaacatccgcttcgccgggaagaaggtggacgagaagcccgaagagaaagaacaagtgactatcaaagagaacatctacttcgaggacggcaccgtgcagaccgccacctttaagggaacctttgccgaggctaccgcagaagcctatagatacgcagacctgctgtccaaagagcatgggaagtatactgctgatctggaagatggggggtatacaatcaatatcagatttgccggc

SEQ ID NO: 62 - DNA, 597 bp, Artificial Sequence
  Synthetic Polynucleotide
atgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 63 - DNA, 396 bp, Artificial Sequence
  Synthetic Polynucleotide
atggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggc

SEQ ID NO: 64 - DNA, 516 bp, Artificial Sequence
  Synthetic Polynucleotide
atgggcaacgaggccagctaccctctggagatgtgctcccacttcgacgccgacgagatcaagcggctgggcaagcgcttcaagaagctggacctggacaacagcggcagcctgagcgtggaggagtttatgtctctgcccgagctgcagcagaaccccctggtgcagcgcgtgatcgacatcttcgacaccgacggcaacggcgaggtggacttcaaggagttcatcgagggcgtgagccagttcagcgtgaagggcgacaaggagcagaagctgcggttcgccttccgcatctacgatatggataaagatggctatatttctaatggcgagctgttccaggtgctgaagatgatggtgggcaacaataccaagctggccgatacccagctgcagcagatcgtggacaagaccatcatcaacgccgacaaggacggcgacggcagaatcagcttcgaggagttctgtgccgtggtgggaggcctggatattcacaaaaaaatggtggtggacgtg

SEQ ID NO: 65 - DNA, 1071 bp, Artificial Sequence
  Synthetic Polynucleotide
atgctgctgctcgtgaccagcctgctgctgtgcgaactgccccaccctgcctttctgctgatcccccggaaagtgtgcaacggcatcggcatcggagagttcaaggacagcctgagcatcaacgccaccaacatcaagcacttcaagaactgcaccagcatcagcggcgacctgcacatcctgcccgtggcctttagaggcgacagcttcacccacacccccccactggaccctcaggaactggacatcctgaaaaccgtgaaagagatcaccggatttctgctgattcaggcttggcccgagaaccggaccgatctgcacgccttcgagaacctggaaatcatccggggcaggaccaagcagcacggccagttttctctggccgtggtgtccctgaacatcaccagcctgggcctgcggagcctgaaagaaatcagcgacggggatgtgattatcagcggcaacaagaacctgtgctacgccaacaccatcaactggaagaagctgttcggcacctccggccagaaaacaaagatcatcagcaaccggggcgagaacagctgcaaggccacaggacaagtgtgccacgccctgtgtagccctgagggctgttggggacccgagcccagagattgcgtgtcctgccggaatgtgtccagaggccgcgagtgcgtggacaagtgcaacctgctggaaggcgagccccgcgagtttgtggaaaacagcgagtgcatccagtgccaccccgagtgtctgccccaggccatgaatatcacctgtaccggcagaggccccgacaactgtatccagtgcgcccactacatcgacggcccccactgcgtgaaaacctgtccagctggcgtgatgggagagaacaacaccctcgtgtggaagtacgccgacgccggccatgtgtgccacctgtgtcaccccaactgcacctacggctgtacaggccctggcctggaaggctgccctaccaacggacccaagatccccagcattgccaccggcatggtgggagcattgctgctgctgctggtggtggccctgggcatcggcctgtttatg

SEQ ID NO: 66 - DNA, 1272 bp, Artificial Sequence
  Synthetic Polynucleotide
atgcgaccctccgggacggccggggcagcgttcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcct

SEQ ID NO: 67 - DNA, 999 bp, Artificial Sequence
  Synthetic Polynucleotide
atgccccctcccagactgctgttcttcctgctgttcctgacccctatggaagtgcggcccgaggaacccctggtcgtgaaagtggaagagggcgacaacgccgtgctccagtgtctgaagggcacctccgatggccctacccagcagctgacatggtccagagagagccccctgaagcccttcctgaagctgtctctgggcctgcctggcctgggcatccacatgaggccactggctatctggctgttcatcttcaacgtgtcccagcagatgggcggcttctacctgtgtcagcctggccccccaagcgagaaagcctggcagcctggctggaccgtgaacgtggaaggatctggcgagctgttccggtggaacgtgtccgatctgggcggcctgggatgcggcctgaagaacagaagcagcgaaggccccagcagccccagcggcaaactgatgagccccaagctgtacgtgtgggccaaggaccggcccgagatttgggaaggcgagcctccttgcctgccccccagagatagcctgaaccagagcctgagccaggacctgacaatggcccctggcagcacactgtggctgagctgtggcgtgccacccgactctgtgtccagaggccctctgagctggacccacgtgcaccccaagggacctaagagcctgctgagcctggaactgaaggacgacagacccgccagagatatgtgggtcatggaaaccggcctgctgctgcctagagccacagcccaggatgccggcaagtattactgccaccggggcaacctgaccatgagcttccacctggaaatcaccgccagacccgtgctgtggcactggctgctgagaaccggcggatggaaagtgtccgccgtgaccctggcctacctgatcttctgcctgtgctccctcgtgggcatcctgcatctccagcgggctctggtgctgcggcggaagagaaagagaatgaccgaccccacccggcggttc

SEQ ID NO: 68 - DNA, 315 bp, Artificial Sequence
  Synthetic Polynucleotide
atggccttaccagtgaccgccttgctcctgccgctggccttgctgctccacgccgccaggccgttcgaaatgctgcaaatggccggacagtgcagccagaacgagtatttcgacagcctgctgcacgcctgcattccctgccagctgagatgcagcagcaacacccctccactgacctgccagagatactgcaatgccagcgtgaccaacagcgtgaagggcaccaatgccatcctgtggacatgtctgggcctgagcctgattatcagcctggccgtgttcgtgctgatgttcctgctgcggaagatcaacagc

SEQ ID NO: 69 - DNA, 390 bp, Artificial Sequence
  Synthetic Polynucleotide
atgctgctgctggtcacatctctgctgctgtgcgagctgccccatcctgcctttctgctgattgagctgcctacacagggcaccttcagcaacgtgtccaccaatgtgtccccagccaagcctacaacaacagctggtggaggaagcctgcaaatggccggacagtgcagccagaacgagtatttcgacagcctgctgcacgcctgcattccctgccagctgagatgcagcagcaacacccctccactgacctgccagagatactgcaatgccagcgtgaccaacagcgtgaagggcaccaatgccatcctgtggacatgtctgggcctgagcctgattatcagcctggccgtgttcgtgctgatgttcctgctgcggaagatcaacagc

SEQ ID NO: 70 - DNA, 471 bp, Artificial Sequence
  Synthetic Polynucleotide
atggccctgcctgtgacagctctgctgctgcctctggcactgctgctgcacgccgccagaccttgcccctacagcaatcctagcctgtgttctggcggcggaggaagcgaacttcctacacagggcaccttcagcaacgtgtccaccaatgtgtccccagccaagcctaccaccaccgcctgtccttactccaatccatctctgtgcagcggaggcggcggatctcctgctcctagacctcctacaccagctcctacaatcgccagccagcctctgtctctcagacccgaagcctgtagacctgctgctggcggagctgtgcataccagaggactggatttcgcctgcgacatctacatctgggctcctctggctggcacatgtggcgttctgctgctgagcctggtcatcaccctgtactgcaaccaccggaacaggcggagagtgtgcaagtgccctagacctgtggtt

SEQ ID NO: 71 - DNA, 867 bp, Artificial Sequence
  Synthetic Polynucleotide
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataa

SEQ ID NO: 72 - DNA, 870 bp, Artificial Sequence
  Synthetic Polynucleotide
atgaggatatttgctgtctttatattcatgacctactggcatctgctgaacgccttcaccgtgaccgtgcctaaggacctgtacgtggtggaatacggcagcaacatgaccatcgagtgcaagttccccgtggaaaagcagctggatctggccgctctgatcgtgtactgggagatggaagataagaacatcatccagttcgtgcatggcgaagaggacctgaaggtgcagcacagcagctacagacagagagccagactgctgaaggaccagctgagcctgggaaatgccgctctccagatcaccgacgtgaagctgcaagacgccggggtgtacagatgcatgatctcttacggcggagccgactacaagcggatcaccgtgaaagtgaacgccccttacaacaagatcaaccagagaatcctggtggtggaccccgtgacatctgagcacgagctgacttgtcaggccgagggctatcctaaggccgaagtgatttggaccagcagcgaccaccaggtgctgagcggaaagaccaccaccacaaacagcaagcgggaagagaagctgttcaacgtgaccagcacactgcggatcaacacaaccaccaacgagattttctactgcacctttcggcggctggaccccgaggaaaatcacacagccgagctggtcatccccgagctgcctcttgctcaccctcctaacgagagaacccacctcgtgatcctgggagccatcctgctgtgtctgggagtcgccctgaccttcatcttccggctgagaaagggcagaatgatggacgtgaagaagtgcggcatccaggacaccaacagcaagaagcagagcgatacacatttggaggagacg

SEQ ID NO: 73 - DNA, 819 bp, Artificial Sequence
  Synthetic Polynucleotide
atgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatccccttctgcatcattgctttcattttcatagccacagtgatagccctaagaaaacaactctgtcaaaagctgtattcttcaaaagacacaacaaaaagacctgtcaccacaacaaagagggaagtgaacagtgctatc

SEQ ID NO: 74 - DNA, 390 bp, Artificial Sequence
  Synthetic Polynucleotide
atggacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcc

SEQ ID NO: 75 - DNA, 564 bp, Artificial Sequence
  Synthetic Polynucleotide
atggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 76 - DNA, 723 bp, Artificial Sequence
  Synthetic Polynucleotide
atgtccgactccaaggaggtccctagccttccatttttgcgacacttgctcgaagagttggacagccatgaggacagcttgctgctgtttctgtgtcacgacgcggccccgggctgcacgacggtcacgcaagctttgtgctcgcttagccaacagcgcaagctgaccctcgcggctctggtcgagatgctctacgtgctgcagcgtatggatcttctcaagagccgcttcgggctcagcaaggagggggccgagcaattgctgggcacaagctttctcacgcgctaccgcaagctcatggtttgcgtgggtgaggagctcgactcgagcgagctacgcgctctacgcttgttcgcgtgcaacctgaatccgagcctgagcacggcgctttctgagagcagccgctttgtcgagcttgtactcgcgcttgaaaacgtaggactcgtctcgccatcgagtgtttccgtgcttgcggacatgttgcgcactcttcggcgcctcgatttgtgccagcagcttgttgagtacgaacaacaagagcaagccaggtaccgttactgttacgcggcctcgccctcattgccagttcgtacgttacgtcgggggcacggcgcgagtgaacacgagcagctgtgcatgcccgtgcaagaatcctctgacagccccgagctgctgcgcacgcccgtacaagaatcctccagcgacagccccgagcaaacgact

SEQ ID NO: 77 - DNA, 1023 bp, Artificial Sequence
  Synthetic Polynucleotide
atggatatcttcagggaaatcgcatcttctatgaaaggagagaatgtattcatttctccaccgtcaatctcgtcagtattgacaatactgtattatggagctaatggatccactgctgaacagctatcaaaatatgtagaaaaggaggcggacaagaataaggatgatatctcattcaagtccatgaataaagtatatgggcgatattctgcagtgtttaaagattcctttttgagaaaaattggagataatttccaaactgttgacttcactgattgtcgcactgtagatgcgatcaacaagtgtgttgatatcttcactgaggggaaaattaatccactattggatgaaccattgtctccagatacctgtctcctagcaattagtgccgtatactttaaagcaaaatggttgatgccatttgaaaaggaatttaccagtgattatcccttttacgtatctccaacggaaatggtagatgtaagtatgatgtctatgtacggcgaggcatttaatcacgcatctgtaaaagaatcattcggcaacttttcaatcatagaactgccatatgttggagatactagtatggtggtaattcttccagacaatattgatggactagaatccatagaacaaaatctaacagatacaaattttaagaaatggtgtgactctatggatgctatgtttatcgatgtgcacattcccaagtttaaggtaacaggctcgtataatctggtggatgcgctagtaaagttgggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcgctggtggcagactgtgcatcaacagttacaaatgagttctgtgcagatcatccgttcatctatgtgattaggcatgtcgatggcaaaattcttttcgttggtagatattgctctccaacaactaat

SEQ ID NO: 78 - DNA, 897 bp, Artificial Sequence
  Synthetic Polynucleotide
atgtgtgtaatttttccggtagaaatcgacgtgtcccagacgattattcgagattgtcaggtggacaaacaaaccagagagttggtgtacattaacaagattatgaacacgcaattgacaaaacccgttctcatgatgtttaacatttcgggtcctatacgaagcgttacgcgcaagaacaacaatttgcgcgacagaataaaatcaaaagtcgatgaacaatttgatcaactagaacgcgattacagcgatcaaatggatggattccacgatagcatcaagtattttaaagatgaacactattcggtaagttgccaaaatggcagcgtgttgaaaagcaagtttgctaaaattttaaagagtcatgattataccgataaaaagtctattgaagcttacgagaaatactgtttgcccaaattggtcgacgaacgcaacgactactacgtggcggtatgcgtgttgaagccgggatttgagaacggcagcaaccaagtgctatctttcgagtacaacccgattggtaacaaagttattgtgccgtttgctcacgaaattaacgacacgggactttacgagtacgacgtcgtagcttacgtggacagtgtgcagtttgatggcgaacaatttgaagagtttgtgcagagtttaatattgccgtcgtcgttcaaaaattcggaaaaggttttatattacaacgaagcgtcgaaaaacaaaagcatgatctacaaggctttagagtttactacagaatcgagctggggcaaatccgaaaagtataattggaaaattttttgtaacggttttatttatgataaaaaatcaaaagtgttgtatgttaaattgcacaatgtaactagtgcactcaacaaaaatgtaatattaaacacaattaaa

SEQ ID NO: 79 - DNA, 651 bp, Artificial Sequence
  Synthetic Polynucleotide
atggatccccagtgcactatgggactgagtaacattctctttgtgatggccttcctgctctctgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttt

SEQ ID NO: 80 - DNA, 423 bp, Artificial Sequence
  Synthetic Polynucleotide
gatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 81 - DNA, 420 bp, Artificial Sequence
  Synthetic Polynucleotide
atccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 82 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 83 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 84 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 85 - DNA, 411 bp, Artificial Sequence
  Synthetic Polynucleotide
cctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 86 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 87 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 88 - DNA, 531 bp, Artificial Sequence
  Synthetic Polynucleotide
gaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 89 - DNA, 537 bp, Artificial Sequence
  Synthetic Polynucleotide
gaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 90 - DNA, 537 bp, Artificial Sequence; identical to SEQ ID NO: 89
  Synthetic Polynucleotide

SEQ ID NO: 91 - DNA, 537 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 92 - DNA, 537 bp, Artificial Sequence
  Synthetic Polynucleotide
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 93 - DNA, 537 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 94 - DNA, 537 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 95 - DNA, 567 bp, Artificial Sequence
  Synthetic Polynucleotide
gataaacaacttgatgcagatgtttcccccaagcccactatttttcttccttcaattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatca

SEQ ID NO: 96 - DNA, 519 bp, Artificial Sequence
  Synthetic Polynucleotide
gacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 97 - DNA, 459 bp, Artificial Sequence
  Synthetic Polynucleotide
agtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttg

SEQ ID NO: 98 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcctgatcctgctgctgaaagtggccggctttaacctgctgatgaccctgcggctgtggtccagc

SEQ ID NO: 99 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcctgatcctgctgctgaaagtggccggctttaacctgctgatgaccctgcggctgtggtccagc

SEQ ID NO: 100 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcctgatcctgctgctgaaagtggccggctttaacctgctgatgaccctgcggctgtggtccagc

SEQ ID NO: 101 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcctgatcctgctgctgaaagtggccggctttaacctgctgatgaccctgcggctgtggtccagc

SEQ ID NO: 102 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcctgatcctgctgctgaaagtggccggctttaacctgctgatgaccctgcggctgtggtccagc

SEQ ID NO: 103 - DNA, 489 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcctgatcctgctgctgaaagtggccggctttaacctgctgatgaccctgcggctgtggtccagc

SEQ ID NO: 104 - DNA, 489 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcctgatcctgctgctgaaagtggccggctttaacctgctgatgaccctgcggctgtggtccagc

SEQ ID NO: 105 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagc

SEQ ID NO: 106 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagc

SEQ ID NO: 107 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagc

SEQ ID NO: 108 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagc

SEQ ID NO: 109 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagc

SEQ ID NO: 110 - DNA, 489 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagc

SEQ ID NO: 111 - DNA, 489 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagc

SEQ ID NO: 112 - DNA, 216 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgc

SEQ ID NO: 113 - DNA, 678 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 114 - DNA, 342 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 115 - DNA, 126 bp, Artificial Sequence
  Synthetic Polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 116 - DNA, 336 bp, Artificial Sequence
  Synthetic Polynucleotide
agagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 117 - DNA, 336 bp, Artificial Sequence
  Synthetic Polynucleotide
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 118 - DNA, 324 bp, Artificial Sequence
  Synthetic Polynucleotide
aaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctcc

SEQ ID NO: 119 - DNA, 450 bp, Artificial Sequence
  Synthetic Polynucleotide
ttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 120 - DNA, 555 bp, Artificial Sequence
  Synthetic Polynucleotide
gacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgcaaaatccagattatgagcctattcggaaaggacagagggacctgtactctggcctgaatcagagaagaatc

SEQ ID NO: 121 - DNA, 480 bp, Artificial Sequence
  Synthetic Polynucleotide
cagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 122 - DNA, 429 bp, Artificial Sequence
  Synthetic Polynucleotide
cagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 123 - DNA, 519 bp, Artificial Sequence
  Synthetic Polynucleotide
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 124 - DNA, 477 bp, Artificial Sequence
  Synthetic Polynucleotide
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 125 - DNA, 477 bp, Artificial Sequence
  Synthetic Polynucleotide
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 126 - DNA, 513 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 127 - DNA, 489 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 128 - DNA, 489 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 129 - DNA, 702 bp, Artificial Sequence
  Synthetic Polynucleotide
cctgctgaacccaaatccccagacaagacacatacctgccccccttgccctgcgcctcccgtcgccgggccttctgtcttccttttccctcccaagcccaaagacacgttgatgattgcccgaactccagaggtaacgtgtgttgtcgtcgatgttagccatgaggacccagaggttaagttcaattggtatgtggacggtgttgaagttcataatgctaagacaaaacctagggaggaacaatacaattcaacatatcgggtcgtcagtgtcctcaccgtccttcaccaagattggctcaatggtaaagaatataagtgcaaagtctcaaataaggcgcttcctgcgcccatcgaaaaaaccatttccaaggccaagggacaacctagagagccacaggtgtatacgcttccgccgagtcgggatgaattgacgaaaaaccaggtgagcctgacatgcttggtcaaagggttttatccaagcgacattgctgtcgagtgggaatccaacggccagcctgaaaataactacaaaaccacaccgcccgtactggacagtgacggatcattcttcctgtactctaaactcaccgttgacaaatcccggtggcaacagggtaatgtctttagttgcagtgtcatgcatgaggctctgcacaatcattatacccagaaaagtctgagtctgtcacccggtaaaaaa

SEQ ID NO: 130 - DNA, 705 bp, Artificial Sequence
  Synthetic Polynucleotide
ccagctgaaccaaaaagtcccgataaaacgcatacctgtccaccatgcccagcgccccctgtcgctgggccaagtgtttttctgtttcctccgaagccaaaggatacgctgatgattgcaagaactccagaagtcacctgcgtcgtcgtggatgtttctcacgaggacccagaggtaaagttcaactggtatgtagacggagtcgaagtacacaatgctaaaaccaaaccgcgcgaggaacaatacaattcaacttaccgggtcgtatctgtgcttaccgtcctccaccaagattggctgaatgggaaagaatacaaatgcaaagtcagtaataaggcgctgccggcacctatcgaaaagacgatctctaaggcaaaggggcagcccagagaaccgcaagtgtatacgcttccgccatcacgagatgagctgacgaagaaccaagtctcattgacttgcttggtgaaaggcttctacccgtccgacatagccgtggaatgggaaagcaatggtcaacctgagaataactacaagacaacacccccagttctcgacagcgatggtagcttctttttgtatagtaagttgacggtagataagtcacggtggcagcaaggcaacgtattcagttgtagtgtaatgcatgaagcactccataaccattatactcaaaagagcctttcttcactttctcctggaaagaaa

SEQ ID NO: 131 - DNA, 687 bp, Artificial Sequence
  Synthetic Polynucleotide
gaaagtaagtatggccctccgtgccctccgtgccccgcaccggaatttgagggcggaccatccgtgttcctttttccaccaaaacccaaagacacacttatgatttccaggacccctgaagtcacctgcgtcgtggtagacgtttctcaggaagatccggaggttcaatttaactggtacgttgacggtgtagaagtacacaatgccaagactaagccacgggaggagcaatttaattcaacatacagggtagtatcagtcttgacagtattgcaccaggattggctgaacggaaaagagtataagtgtaaggtatctaacaagggtctcccgtcatccatcgagaaaacgatcagtaaagcaaaagggcagccacgggaaccacaagtgtacacactgccacccagtcaagaggagatgactaagaatcaagtaagtcttacgtgtctcgtcaaggggttttatccgtcagacattgctgttgagtgggaatccaatgggcaacccgagaacaattataagaccacaccaccagtccttgatagcgatggcagtttttttctgtactccagactcacagtagataagagccggtggcaggagggcaatgttttctcctgcagcgttatgcacgaagcgcttcataaccactatactcagaaatccttgagtctgagtctcggcaaa

SEQ ID NO: 132 - DNA, 357 bp, Artificial Sequence
  Synthetic Polynucleotide
gagagtaaatacggtccgccgtgtccaccgtgccctggacagccgagggaaccacaggtttacactttgccaccgtcacaggaagaaatgactaaaaaccaggtcagcctcacttgtctggttaagggcttctaccccagcgacattgctgtggagtgggagagcaacggccagccagagaataattacaagaccacgccgcctgtgttggacagtgatggtagtttctttttgtactcacggcttacagtcgacaagagccggtggcaggaaggcaacgttttcagttgctcagtaatgcacgaagccttgcacaaccattatacccaaaaatcactgtcattgagtctcggtaag

SEQ ID NO: 133 - DNA, 36 bp, Artificial Sequence
  Synthetic Polynucleotide
gaatcaaagtacggccccccgtgtcctccatgtcct

SEQ ID NO: 134 - skipped

SEQ ID NO: 135 - DNA, 807 bp, Artificial Sequence
  Synthetic Polynucleotide
gaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctgg

SEQ ID NO: 136 - DNA, 1470 bp, Artificial Sequence
  Synthetic Polynucleotide
atgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcc

SEQ ID NO: 137 - DNA, 501 bp, Artificial Sequence
  Synthetic Polynucleotide
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccag

SEQ ID NO: 138 - DNA, 438 bp, Artificial Sequence
  Synthetic Polynucleotide
ggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccag

SEQ ID NO: 139 - DNA, 501 bp, Artificial Sequence
  Synthetic Polynucleotide
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaa

SEQ ID NO: 140 - DNA, 486 bp, Artificial Sequence
  Synthetic Polynucleotide
atggcctgtctgggcttccagagacacaaggcccagctcaacctggctaccagaacctggccttgtactctgctgttcttcctgctgttcatccccgtgttctgcaaggccatgcatgtggctcagcctgctgtggtgctggcctctagtagaggaatcgccagcttcgtgtgcgagtacgcctctcctggaaaggccactgaagtgcgcgtgaccgttctgagacaggccgatagccaagtgaccgaagtgtgcgccgccacctacatgatgggcaacgagctgaccttcctggacgacagcatctgtaccggcaccagcagcggcaatcaagtgaacctgaccatccagggcctgagagctatggacaccggcctgtacatctgcaaggtggaactgatgtaccctcctccttactacctcggcatcggcaacggcacccaaatctacgtgatcgaccccgagccttgtcctgacagcgatttc

SEQ ID NO: 141 - DNA, 723 bp, Artificial Sequence
  Synthetic Polynucleotide
atgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggg

SEQ ID NO: 142 - DNA, 900 bp, Artificial Sequence
  Synthetic Polynucleotide
atggtgctgctgtggctgaccctgctgctgatcgccctgccttgtctgctgcagaccaaagaggaccccaacccccccatcaccaacctgcggatgaaggccaaagcccagcaactgacctgggacctgaaccggaacgtgaccgacatcgagtgcgtgaaggacgccgactactccatgcccgccgtgaacaacagctactgccagttcggagccatcagcctgtgcgaagtgaccaactacaccgtgcgggtggcaaacccccccttctccacctggattctgttccccgagaacagcggcaagccctgggctggcgctgagaatctgacctgctggattcacgacgtggactttctgagctgctcctgggctgtgggacctggcgctcctgccgatgtgcagtacgacctgtacctgaatgtggctaaccggcggcagcagtacgagtgcctgcactacaagaccgacgcccagggcaccagaatcggctgcagattcgacgacatcagcagactgagcagcggcagccagtccagccacatccttgtgcggggaagaagcgccgccttcggcatcccttgcaccgacaagttcgtggtgttcagccagatcgagatcctgaccccccccaacatgaccgccaagtgcaacaagacccacagcttcatgcactggaagatgcggagccacttcaaccggaagttcagatacgagctgcagatccagaaacggatgcagcccgtgattaccgaacaagtgcgggaccggaccagcttccaactgctgaaccctggcacctacacagtgcagatccgggccagagaacgggtgtacgagttcctgagcgcctggtccaccccccagagattcgagtgcgatcaggaagagggggccaac

SEQ ID NO: 143 - DNA, 2127 bp, Artificial Sequence
  Synthetic Polynucleotide
atgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgcc

SEQ ID NO: 144 - DNA, 717 bp, Artificial Sequence
  Synthetic Polynucleotide
atgtcagctccaagattactgatttccatcattatcatggtgtctgcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcttccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactg

SEQ ID NO: 145 - DNA, 1464 bp, Artificial Sequence
  Synthetic Polynucleotide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagcgcc

SEQ ID NO: 146 - DNA, 1992 bp, Artificial Sequence
  Synthetic Polynucleotide
atgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagacc

SEQ ID NO: 147 - DNA, 756 bp, Artificial Sequence
  Synthetic Polynucleotide
atgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagag

SEQ ID NO: 148 - DNA, 870 bp, Artificial Sequence
  Synthetic Polynucleotide
atgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagacc

SEQ ID NO: 149 - DNA, 804 bp, Artificial Sequence
  Synthetic Polynucleotide
atggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaacaggcgcgc

SEQ ID NO: 150 - DNA, 795 bp, Artificial Sequence
  Synthetic Polynucleotide
atgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaacaaagaatgatatgtgagaagatggccaatccagtgcagcttggttctacatattttagggaggca

SEQ ID NO: 151 - DNA, 489 bp, Artificial Sequence
  Synthetic Polynucleotide
atggccttaccagtgaccgccttgctcctgccgctggccttgctgctccacgccgccaggccgttcgaatgtcctgccggcatctacgcccctatctgttctggcggagggggatcttgtgggggaggcggcagcaagatcagccacttcctgaagatggaaagcctgaacttcatcagagcccacaccccctacatcaacatctacaactgcgagcccgccaaccccagcgagaagaacagccccagcacccagtattgctacagcatccagagcggaggcggcggaagttgtggaggcggaggctctcctgctggaatctatgctcctatcggaggcggaggctccaagatttcccactttctgaaaatggaatctctgaatttcatccgggctcacacaccttacatcaatatctataactgcgaacctgccaatccctctgagaagaactccccatccacacagtattgctattccatccagtcc

SEQ ID NO: 152 - DNA, 315 bp, Artificial Sequence
  Synthetic Polynucleotide
atggccttaccagtgaccgccttgctcctgccgctggccttgctgctccacgccgccaggccgttcgaatgtcctgccggcatctacgcccctatctgttctggcggagggggatcttgtgggggaggcggcagcaagatcagccacttcctgaagatggaaagcctgaacttcatcagagcccacaccccctacatcaacatctacaactgcgagcccgccaaccccagcgagaagaacagccccagcacccagtattgctacagcatccagagcggaggcggcggaagttgtggaggcggaggctctacgcgt

SEQ ID NO: 153 - DNA, 1545 bp, Artificial Sequence
  Synthetic Polynucleotide
atgtctctgtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcga

SEQ ID NO: 154 - DNA, 1239 bp, Artificial Sequence
  Synthetic Polynucleotide
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttattcttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggc

SEQ ID NO: 155 - DNA, 1083 bp, Artificial Sequence
  Synthetic Polynucleotide
atgcgaccctccgggacggccggggcagcgctcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgc

SEQ ID NO: 156 - DNA, 163 bp, Artificial Sequence
  Synthetic Polynucleotide
atgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcga

SEQ ID NO: 157 - DNA, 678 bp, Artificial Sequence
  Synthetic Polynucleotide
atggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatg

SEQ ID NO: 158 - DNA, 405 bp, Artificial Sequence
  Synthetic Polynucleotide
ctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtg

SEQ ID NO: 159 - skipped

SEQ ID NO: 160 - DNA, 2025 bp, Artificial Sequence
  Synthetic Polynucleotide
atgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgccacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcc

SEQ ID NO: 161 - DNA, 1449 bp, Artificial Sequence
  Synthetic Polynucleotide
atgccacctcctcgcctcctcttcttcctcctcttcctcacccccatggaagtcaggcccgactacaaggacgacgatgacaaggaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctggacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcc

SEQ ID NO: 162 - DNA, 2298 bp, Artificial Sequence
  Synthetic Polynucleotide
atgccacctcctcgcctcctcttcttcctcctcttcctcacccccatggaagtcaggcccgactacaaggacgacgatgacaaggaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctggacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 163 - DNA, 2220 bp, Artificial Sequence
  Synthetic Polynucleotide
atgccacctcctcgcctcctcttcttcctcctcttcctcacccccatggaagtcaggcccgactacaaggacgacgatgacaaggaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctggggaggcagtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 164 - DNA, 2160 bp, Artificial Sequence
  Synthetic Polynucleotide
atgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 165 - DNA, 2088 bp, Artificial Sequence
  Synthetic Polynucleotide
atgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagacgcgtggaggcagtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 166 - DNA, 2127 bp, Artificial Sequence
  Synthetic Polynucleotide
atgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacggggacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 167 - DNA, 2304 bp, Artificial Sequence
  Synthetic Polynucleotide
atggtgctgctgtggctgaccctgctgctgatcgccctgccttgtctgctgcagaccaaagaggaccccaacccccccatcaccaacctgcggatgaaggccaaagcccagcaactgacctgggacctgaaccggaacgtgaccgacatcgagtgcgtgaaggacgccgactactccatgcccgccgtgaacaacagctactgccagttcggagccatcagcctgtgcgaagtgaccaactacaccgtgcgggtggcaaacccccccttctccacctggattctgttccccgagaacagcggcaagccctgggctggcgctgagaatctgacctgctggattcacgacgtggactttctgagctgctcctgggctgtgggacctggcgctcctgccgatgtgcagtacgacctgtacctgaatgtggctaaccggcggcagcagtacgagtgcctgcactacaagaccgacgcccagggcaccagaatcggctgcagattcgacgacatcagcagactgagcagcggcagccagtccagccacatccttgtgcggggaagaagcgccgccttcggcatcccttgcaccgacaagttcgtggtgttcagccagatcgagatcctgaccccccccaacatgaccgccaagtgcaacaagacccacagcttcatgcactggaagatgcggagccacttcaaccggaagttcagatacgagctgcagatccagaaacggatgcagcccgtgattaccgaacaagtgcgggaccggaccagcttccaactgctgaaccctggcacctacacagtgcagatccgggccagagaacgggtgtacgagttcctgagcgcctggtccaccccccagagattcgagtgcgatcaggaagagggggccaacacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 168 - DNA, 3531 bp, Artificial Sequence
  Synthetic Polynucleotide
atgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 169 - DNA, 2121 bp, Artificial Sequence
  Synthetic Polynucleotide
atgtcagctccaagattactgatttccatcattatcatggtgtctgcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcttccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 170 - DNA, 2868 bp, Artificial Sequence
  Synthetic Polynucleotide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagcgccacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 171 - DNA, 3396 bp, Artificial Sequence
  Synthetic Polynucleotide
atgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 172 - DNA, 2274 bp, Artificial Sequence
  Synthetic Polynucleotide
atgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 173 - DNA, 2208 bp, Artificial Sequence
  Synthetic Polynucleotide
atggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaacaggcgcgcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 174 - DNA, 2199 bp, Artificial Sequence
  Synthetic Polynucleotide
atgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaacaaagaatgatatgtgagaagatggccaatccagtgcagcttggttctacatattttagggaggcaacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 175 - DNA, 1893 bp, Artificial Sequence
  Synthetic Polynucleotide
atggccttaccagtgaccgccttgctcctgccgctggccttgctgctccacgccgccaggccgttcgaatgtcctgccggcatctacgcccctatctgttctggcggagggggatcttgtgggggaggcggcagcaagatcagccacttcctgaagatggaaagcctgaacttcatcagagcccacaccccctacatcaacatctacaactgcgagcccgccaaccccagcgagaagaacagccccagcacccagtattgctacagcatccagagcggaggcggcggaagttgtggaggcggaggctctcctgctggaatctatgctcctatcggaggcggaggctccaagatttcccactttctgaaaatggaatctctgaatttcatccgggctcacacaccttacatcaatatctataactgcgaacctgccaatccctctgagaagaactccccatccacacagtattgctattccatccagtccacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 176 - DNA, 1719 bp, Artificial Sequence
  Synthetic Polynucleotide
atggccttaccagtgaccgccttgctcctgccgctggccttgctgctccacgccgccaggccgttcgaatgtcctgccggcatctacgcccctatctgttctggcggagggggatcttgtgggggaggcggcagcaagatcagccacttcctgaagatggaaagcctgaacttcatcagagcccacaccccctacatcaacatctacaactgcgagcccgccaaccccagcgagaagaacagccccagcacccagtattgctacagcatccagagcggaggcggcggaagttgtggaggcggaggctctacgcgtacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 177 - DNA, 2949 bp, Artificial Sequence
  Synthetic Polynucleotide
atgtctctgtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgaacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 178 - DNA, 2643 bp, Artificial Sequence
  Synthetic Polynucleotide
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttattcttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 179 - DNA, 2487 bp, Artificial Sequence
  Synthetic Polynucleotide
atgcgaccctccgggacggccggggcagcgctcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 180 - DNA, 1635 bp, Artificial Sequence
  Synthetic Polynucleotide
atggccttaccagtgaccgccttgctcctgccgctggccttgctgctccacgccgccaggccgttcgaaatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 181 - DNA, 2082 bp, Artificial Sequence
  Synthetic Polynucleotide
atggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatgacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 182 - DNA, 1905 bp, Artificial Sequence
  Synthetic Polynucleotide
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 183 - DNA, 1890 bp, Artificial Sequence
  Synthetic Polynucleotide
atggcctgtctgggcttccagagacacaaggcccagctcaacctggctaccagaacctggccttgtactctgctgttcttcctgctgttcatccccgtgttctgcaaggccatgcatgtggctcagcctgctgtggtgctggcctctagtagaggaatcgccagcttcgtgtgcgagtacgcctctcctggaaaggccactgaagtgcgcgtgaccgttctgagacaggccgatagccaagtgaccgaagtgtgcgccgccacctacatgatgggcaacgagctgaccttcctggacgacagcatctgtaccggcaccagcagcggcaatcaagtgaacctgaccatccagggcctgagagctatggacaccggcctgtacatctgcaaggtggaactgatgtaccctcctccttactacctcggcatcggcaacggcacccaaatctacgtgatcgaccccgagccttgtcctgacagcgatttcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 184 - DNA, 1872 bp, Artificial Sequence
  Synthetic Polynucleotide
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 185 - DNA, 2568 bp, Artificial Sequence
  Synthetic Polynucleotide
atggccttaccagtgaccgccttgctcctgccgctggccttgctgctccacgccgccaggccggaattcaaagaggaaacccccgagacacccgaaaccgacagcgaggaagaagtgaccatcaaggccaacctgatcttcgccaacggcagcacccagaccgccgagttcaagggcaccttcgagaaggccaccagcgaagcctacgcctacgccgacaccctgaagaaggacaacggcgagtacaccgtggacgtggccgacaagggctacacactgaacatcaagttcgccggcaaagaaaagacccccgaggaacccaaagaagaagtgactattaaggctaatctgatctacgctgacggcaagacacagacagctgagtttaaggggacattcgaagaagccaccgccgaggcttacagatacgccgatgccctgaaaaaagataatggggagtatacagtggatgtggctgataagggatataccctgaatattaagtttgctgggaaagagaaaacacctgaagaacctaaagaagaagtgacaatcaaagcaaacctgatctatgccgatggaaagacccagactgctgagttcaaaggcacttttgaagaggccactgccgaagcctatcgctatgctgacctgctggctaaagagaacggaaagtacactgtggatgtggcagacaaagggtatactctgaatatcaaattcgccggaaaagagaaaactccagaggaacccaaagaagaagtgaccatcaaagccaatctgatctacgcagatgggaaaactcagaccgcagagtttaaagggactttcgccgaggccacagctgaggcatatagatatgccgatctgctggcaaaagaaaatggcaagtataccgccgacctggaagatggcggctacaccatcaacatccgcttcgccgggaagaaggtggacgagaagcccgaagagaaagaacaagtgactatcaaagagaacatctacttcgaggacggcaccgtgcagaccgccacctttaagggaacctttgccgaggctaccgcagaagcctatagatacgcagacctgctgtccaaagagcatgggaagtatactgctgatctggaagatggggggtatacaatcaatatcagatttgccggcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 186 - DNA, 2565 bp, Artificial Sequence
  Synthetic Polynucleotide
atggccttaccagtgaccgccttgctcctgccgctggccttgctgctccacgccgccaggccggaattcaaagaggaaacccccgagacacccgaaaccgacagcgaggaagaagtgaccatcaaggccaacctgatcttcgccaacggcagcacccagaccgccgagttcaagggcaccttcgagaaggccaccagcgaagcctacgcctacgccgacaccctgaagaaggacaacggcgagtacaccgtggacgtggccgacaagggctacacactgaacatcaagttcgccggcaaagaaaagacccccgaggaacccaaagaagaagtgactattaaggctaatctgatctacgctgacggcaagacacagacagctgagtttaaggggacattcgaagccaccgccgaggcttacagatacgccgatgccctgaaaaaagataatggggagtatacagtggatgtggctgataagggatataccctgaatattaagtttgctgggaaagagaaaacacctgaagaacctaaagaagaagtgacaatcaaagcaaacctgatctatgccgatggaaagacccagactgctgagttcaaaggcacttttgaagaggccactgccgaagcctatcgctatgctgacctgctggctaaagagaacggaaagtacactgtggatgtggcagacaaagggtatactctgaatatcaaattcgccggaaaagagaaaactccagaggaacccaaagaagaagtgaccatcaaagccaatctgatctacgcagatgggaaaactcagaccgcagagtttaaagggactttcgccgaggccacagctgaggcatatagatatgccgatctgctggcaaaagaaaatggcaagtataccgccgacctggaagatggcggctacaccatcaacatccgcttcgccgggaagaaggtggacgagaagcccgaagagaaagaacaagtgactatcaaagagaacatctacttcgaggacggcaccgtgcagaccgccacctttaagggaacctttgccgaggctaccgcagaagcctatagatacgcagacctgctgtccaaagagcatgggaagtatactgctgatctggaagatggggggtatacaatcaatatcagatttgccggcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 187 - skipped

SEQ ID NO: 188 - DNA, 2193 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 189 - DNA, 2196 bp, Artificial Sequence
  Synthetic Polynucleotide
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 190 - DNA, 2199 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 191 - DNA, 2199 bp, Artificial Sequence
  Synthetic Polynucleotide
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 192 - DNA, 2199 bp, Artificial Sequence
  Synthetic Polynucleotide
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 193 - DNA, 2202 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 194 - DNA, 2208 bp, Artificial Sequence
  Synthetic Polynucleotide
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 195 - DNA, 2211 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 196 - DNA, 2220 bp, Artificial Sequence
  Synthetic Polynucleotide
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 197 - DNA, 2208 bp, Artificial Sequence
  Synthetic Polynucleotide
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 198 - DNA, 2199 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 199 - DNA, 2211 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 200 - DNA, 2190 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 201 - DNA, 2193 bp, Artificial Sequence
  Synthetic Polynucleotide
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 202 - DNA, 2190 bp, Artificial Sequence
  Synthetic Polynucleotide
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 203 - DNA, 2187 bp, Artificial Sequence
  Synthetic Polynucleotide
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 204 - DNA, 780 bp, Artificial Sequence
  Synthetic Polynucleotide
atggccttaccagtgaccgccttgctcctgccgctggccttgctgctccacgccgccaggccggacatcgtgctgacacagagccctgcttccctggccgtgtccctgggacagagagccaccatctcttgcagagccagcgagagcgtggacgactacggcatcagcttcatgaactggttccagcagaagcccggccagccccccaagctgctgatctatgccgcccctaatcagggcagcggcgtgccagccagattttctggcagcggctccggcaccgacttcagcctgaacatccaccctatggaagaggacgacaccgccatgtacttttgccagcagagcaaggacgtgcggtggcggcatcaggctggcgatcagacaggcggaggcggaagtggaggcggaggatctggcggcggaggctctgaagtgaagctggtggaatccggcggagggctggtgcagcctggcggatctctgaagctgagctgtgccgccagcggcttcgacttctcccggtactggatgagctgggtgcgccaggcccctggcaaaggactggaatggatcggcgagatcaacctggacagcagcaccatcaactacacccccagcctgaaggacaagttcatcatcagccgggacaacgccaagaacaccctgtacctccagatgagcaaagtgcggagcgaggataccgccctgtactactgcgctcggagatacgacgctatggactactggggccagggcaccagcgtgaccgtgtcatct

SEQ ID NO: 205 - DNA, 734 bp, Artificial Sequence
  Synthetic Polynucleotide
atggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgt

SEQ ID NO: 206 - DNA, 735 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgt

SEQ ID NO: 207 - DNA, 735 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgt

SEQ ID NO: 208 - DNA, 738 bp, Artificial Sequence
  Synthetic Polynucleotide
atggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgt

SEQ ID NO: 209 - DNA, 759 bp, Artificial Sequence
  Synthetic Polynucleotide
atggacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgt

SEQ ID NO: 210 - DNA, 810 bp, Artificial Sequence
  Synthetic Polynucleotide
atgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgt

SEQ ID NO: 211 - DNA, 741 bp, Artificial Sequence
  Synthetic Polynucleotide
atggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgt

SEQ ID NO: 212 - DNA, 738 bp, Artificial Sequence
  Synthetic Polynucleotide
atgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgt

SEQ ID NO: 213 - DNA, 756 bp, Artificial Sequence
  Synthetic Polynucleotide
atgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgt

SEQ ID NO: 214 - DNA, 771 bp, Artificial Sequence
  Synthetic Polynucleotide
atgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgt

SEQ ID NO: 215 - DNA, 732 bp, Artificial Sequence
  Synthetic Polynucleotide
atggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgt

SEQ ID NO: 216 - DNA, 762 bp, Artificial Sequence
  Synthetic Polynucleotide
atggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgt

SEQ ID NO: 217 - DNA, 735 bp, Artificial Sequence
  Synthetic Polynucleotide
atggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgt

SEQ ID NO: 218 - DNA, 747 bp, Artificial Sequence
  Synthetic Polynucleotide
atggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgt

SEQ ID NO: 219 - DNA, 741 bp, Artificial Sequence
  Synthetic Polynucleotide
atggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgt

SEQ ID NO: 220 - DNA, 741 bp, Artificial Sequence
  Synthetic Polynucleotide
atggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgt

SEQ ID NO: 221 - DNA, 744 bp, Artificial Sequence
  Synthetic Polynucleotide
atgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgt

SEQ ID NO: 222 - DNA, 738 bp, Artificial Sequence
  Synthetic Polynucleotide
atgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgt

SEQ ID NO: 223 - DNA, 771 bp, Artificial Sequence
  Synthetic Polynucleotide
atgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgt

SEQ ID NO: 224 - DNA, 738 bp, Artificial Sequence
  Synthetic Polynucleotide
atggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgt

SEQ ID NO: 225 - DNA, 741 bp, Artificial Sequence
  Synthetic Polynucleotide
atggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgt

SEQ ID NO: 226 - DNA, 744 bp, Artificial Sequence
  Synthetic Polynucleotide
atggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgt

SEQ ID NO: 227 - DNA, 744 bp, Artificial Sequence
  Synthetic Polynucleotide
atggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgt

SEQ ID NO: 228 - DNA, 744 bp, Artificial Sequence; identical to SEQ ID NO: 227
  Synthetic Polynucleotide

SEQ ID NO: 229 - DNA, 744 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgt

SEQ ID NO: 230 - DNA, 750 bp, Artificial Sequence
  Synthetic Polynucleotide
atggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgt

SEQ ID NO: 231 - DNA, 741 bp, Artificial Sequence
  Synthetic Polynucleotide
atggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgt

SEQ ID NO: 232 - DNA, 750 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgt

SEQ ID NO: 233 - DNA, 744 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgt

SEQ ID NO: 234 - DNA, 741 bp, Artificial Sequence
  Synthetic Polynucleotide
atggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgt

SEQ ID NO: 235 - DNA, 771 bp, Artificial Sequence
  Synthetic Polynucleotide
atgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgt

SEQ ID NO: 236 - DNA, 747 bp, Artificial Sequence
  Synthetic Polynucleotide
atgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgt

SEQ ID NO: 237 - DNA, 741 bp, Artificial Sequence; identical to SEQ ID NO: 234
  Synthetic Polynucleotide

SEQ ID NO: 238 - DNA, 738 bp, Artificial Sequence
  Synthetic Polynucleotide
atggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgt

SEQ ID NO: 239 - DNA, 744 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgt

SEQ ID NO: 240 - DNA, 738 bp, Artificial Sequence
  Synthetic Polynucleotide
atggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgt

SEQ ID NO: 241 - DNA, 753 bp, Artificial Sequence
  Synthetic Polynucleotide
atggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgt

SEQ ID NO: 242 - DNA, 729 bp, Artificial Sequence
  Synthetic Polynucleotide
atggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgt

SEQ ID NO: 243 - DNA, 747 bp, Artificial Sequence
  Synthetic Polynucleotide
atggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgt

SEQ ID NO: 244 - DNA, 747 bp, Artificial Sequence
  Synthetic Polynucleotide
atgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgt

SEQ ID NO: 245 - DNA, 726 bp, Artificial Sequence
  Synthetic Polynucleotide
atggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgt

SEQ ID NO: 246 - DNA, 741 bp, Artificial Sequence
  Synthetic Polynucleotide
atggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgt

SEQ ID NO: 247 - DNA, 732 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgt

SEQ ID NO: 248 - DNA, 762 bp, Artificial Sequence
  Synthetic Polynucleotide
atggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgt

SEQ ID NO: 249 - DNA, 750 bp, Artificial Sequence
  Synthetic Polynucleotide
atggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgt

SEQ ID NO: 250 - DNA, 828 bp, Artificial Sequence
  Synthetic Polynucleotide
atgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgt

SEQ ID NO: 251 - DNA, 825 bp, Artificial Sequence
  Synthetic Polynucleotide
atgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgt

SEQ ID NO: 252 - DNA, 873 bp, Artificial Sequence
  Synthetic Polynucleotide
atggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgt

SEQ ID NO: 253 - DNA, 741 bp, Artificial Sequence
  Synthetic Polynucleotide
atggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgt

SEQ ID NO: 254 - DNA, 738 bp, Artificial Sequence
  Synthetic Polynucleotide
atggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgt

SEQ ID NO: 255 - DNA, 729 bp, Artificial Sequence
  Synthetic Polynucleotide
atggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgt

SEQ ID NO: 256 - DNA, 759 bp, Artificial Sequence
  Synthetic Polynucleotide
atggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgt

SEQ ID NO: 257 - DNA, 720 bp, Artificial Sequence
  Synthetic Polynucleotide
atggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgt

SEQ ID NO: 258 - DNA, 744 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgt

SEQ ID NO: 259 - DNA, 732 bp, Artificial Sequence
  Synthetic Polynucleotide
atggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgt

SEQ ID NO: 260 - DNA, 744 bp, Artificial Sequence
  Synthetic Polynucleotide
atggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgt

SEQ ID NO: 261 - DNA, 732 bp, Artificial Sequence
  Synthetic Polynucleotide
atggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgt

SEQ ID NO: 262 - DNA, 756 bp, Artificial Sequence
  Synthetic Polynucleotide
atggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgt

SEQ ID NO: 263 - DNA, 741 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgt

SEQ ID NO: 264 - DNA, 753 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgt

SEQ ID NO: 265 - DNA, 753 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgt

SEQ ID NO: 266 - DNA, 735 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgt

SEQ ID NO: 267 - DNA, 741 bp, Artificial Sequence
  Synthetic Polynucleotide
atgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgt

SEQ ID NO: 268 - DNA, 732 bp, Artificial Sequence
  Synthetic Polynucleotide
atggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgt

SEQ ID NO: 269 - DNA, 735 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgt

SEQ ID NO: 270 - DNA, 723 bp, Artificial Sequence
  Synthetic Polynucleotide
atggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgt

SEQ ID NO: 271 - DNA, 816 bp, Artificial Sequence
  Synthetic Polynucleotide
atgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgt

SEQ ID NO: 272 - DNA, 729 bp, Artificial Sequence
  Synthetic Polynucleotide
atggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgt

SEQ ID NO: 273 - DNA, 756 bp, Artificial Sequence
  Synthetic Polynucleotide
atggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgt

SEQ ID NO: 274 - DNA, 768 bp, Artificial Sequence
  Synthetic Polynucleotide
atggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgt

SEQ ID NO: 275 - DNA, 741 bp, Artificial Sequence
  Synthetic Polynucleotide
atggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgt

SEQ ID NO: 276 - DNA, 726 bp, Artificial Sequence
  Synthetic Polynucleotide
atggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgt

SEQ ID NO: 277 - DNA, 735 bp, Artificial Sequence
  Synthetic Polynucleotide
atggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgt

SEQ ID NO: 278 - DNA, 720 bp, Artificial Sequence
  Synthetic Polynucleotide
atgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgt

SEQ ID NO: 279 - DNA, 750 bp, Artificial Sequence
  Synthetic Polynucleotide
atggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgt

SEQ ID NO: 280 - DNA, 726 bp, Artificial Sequence
  Synthetic Polynucleotide
atggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgt

SEQ ID NO: 281 - DNA, 735 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgt

SEQ ID NO: 282 - DNA, 765 bp, Artificial Sequence
  Synthetic Polynucleotide
atggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgt

SEQ ID NO: 283 - DNA, 756 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgt

SEQ ID NO: 284 - DNA, 732 bp, Artificial Sequence
  Synthetic Polynucleotide
atggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgt

SEQ ID NO: 285 - DNA, 711 bp, Artificial Sequence
  Synthetic Polynucleotide
atgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgt

SEQ ID NO: 286 - DNA, 726 bp, Artificial Sequence
  Synthetic Polynucleotide
atgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgt

SEQ ID NO: 287 - DNA, 735 bp, Artificial Sequence
  Synthetic Polynucleotide
atggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgt

SEQ ID NO: 288 - DNA, 750 bp, Artificial Sequence
  Synthetic Polynucleotide
atggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgt

SEQ ID NO: 289 - DNA, 735 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgt

SEQ ID NO: 290 - DNA, 753 bp, Artificial Sequence
  Synthetic Polynucleotide
atggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgt

SEQ ID NO: 291 - DNA, 747 bp, Artificial Sequence
  Synthetic Polynucleotide
atggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgt

SEQ ID NO: 292 - DNA, 747 bp, Artificial Sequence
  Synthetic Polynucleotide
atggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgt

SEQ ID NO: 293 - DNA, 741 bp, Artificial Sequence
  Synthetic Polynucleotide
atggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgt

SEQ ID NO: 294 - DNA, 732 bp, Artificial Sequence
  Synthetic Polynucleotide
atggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgt

SEQ ID NO: 295 - DNA, 735 bp, Artificial Sequence
  Synthetic Polynucleotide
atggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgt

SEQ ID NO: 296 - DNA, 741 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgt

SEQ ID NO: 297 - DNA, 744 bp, Artificial Sequence
  Synthetic Polynucleotide
atggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgt

SEQ ID NO: 298 - DNA, 744 bp, Artificial Sequence
  Synthetic Polynucleotide
atggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgt

SEQ ID NO: 299 - DNA, 744 bp, Artificial Sequence
  Synthetic Polynucleotide
atggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgt

SEQ ID NO: 300 - DNA, 738 bp, Artificial Sequence
  Synthetic Polynucleotide
atggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgt

SEQ ID NO: 301 - DNA, 738 bp, Artificial Sequence
  Synthetic Polynucleotide
atggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgt

SEQ ID NO: 302 - DNA, 753 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgt

SEQ ID NO: 303 - DNA, 753 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgt

SEQ ID NO: 304 - DNA, 747 bp, Artificial Sequence
  Synthetic Polynucleotide
atggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgt

SEQ ID NO: 305 - DNA, 732 bp, Artificial Sequence
  Synthetic Polynucleotide
atggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgt

SEQ ID NO: 306 - DNA, 717 bp, Artificial Sequence
  Synthetic Polynucleotide
atggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgt

SEQ ID NO: 307 - DNA, 735 bp, Artificial Sequence
  Synthetic Polynucleotide
atggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgt

SEQ ID NO: 308 - DNA, 756 bp, Artificial Sequence
  Synthetic Polynucleotide
atggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgt

SEQ ID NO: 309 - DNA, 759 bp, Artificial Sequence
  Synthetic Polynucleotide
atggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgt

SEQ ID NO: 310 - DNA, 750 bp, Artificial Sequence
  Synthetic Polynucleotide
atggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgt

SEQ ID NO: 311 - DNA, 741 bp, Artificial Sequence
  Synthetic Polynucleotide
atggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgt

SEQ ID NO: 312 - DNA, 774 bp, Artificial Sequence
  Synthetic Polynucleotide
atggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgt

SEQ ID NO: 313 - DNA, 762 bp, Artificial Sequence
  Synthetic Polynucleotide
atgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgt

SEQ ID NO: 314 - DNA, 744 bp, Artificial Sequence
  Synthetic Polynucleotide
atggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgt

SEQ ID NO: 315 - DNA, 735 bp, Artificial Sequence
  Synthetic Polynucleotide
atggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgt

SEQ ID NO: 316 - DNA, 729 bp, Artificial Sequence
  Synthetic Polynucleotide
atggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgt

SEQ ID NO: 317 - DNA, 735 bp, Artificial Sequence
  Synthetic Polynucleotide
atggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgt

SEQ ID NO: 318 - DNA, 741 bp, Artificial Sequence
  Synthetic Polynucleotide
atgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgt

SEQ ID NO: 319 - DNA, 756 bp, Artificial Sequence
  Synthetic Polynucleotide
atgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgt

SEQ ID NO: 320 - DNA, 738 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgt

SEQ ID NO: 321 - DNA, 741 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgt

SEQ ID NO: 322 - DNA, 738 bp, Artificial Sequence
  Synthetic Polynucleotide
atgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgt

SEQ ID NO: 323 - DNA, 735 bp, Artificial Sequence
  Synthetic Polynucleotide
atgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgt

SEQ ID NO: 324 - DNA, 735 bp, Artificial Sequence
  Synthetic Polynucleotide
atgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgt

SEQ ID NO: 325 - DNA, 741 bp, Artificial Sequence
  Synthetic Polynucleotide
atgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgt

SEQ ID NO: 326 - DNA, 735 bp, Artificial Sequence
  Synthetic Polynucleotide
atggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgt

SEQ ID NO: 327 - DNA, 732 bp, Artificial Sequence
  Synthetic Polynucleotide
atggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgt

SEQ ID NO: 328 - DNA, 732 bp, Artificial Sequence
  Synthetic Polynucleotide
atggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgt

SEQ ID NO: 329 - DNA, 756 bp, Artificial Sequence
  Synthetic Polynucleotide
atggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgt

SEQ ID NO: 330 - DNA, 774 bp, Artificial Sequence
  Synthetic Polynucleotide
atgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgt

SEQ ID NO: 331 - DNA, 729 bp, Artificial Sequence
  Synthetic Polynucleotide
atggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgt

SEQ ID NO: 332 - DNA, 759 bp, Artificial Sequence
  Synthetic Polynucleotide
atggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgt

SEQ ID NO: 333 - DNA, 747 bp, Artificial Sequence
  Synthetic Polynucleotide
atggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgt

SEQ ID NO: 334 - DNA, 699 bp, Artificial Sequence
  Synthetic Polynucleotide
atggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgt

SEQ ID NO: 335 - DNA, 729 bp, Artificial Sequence
  Synthetic Polynucleotide
atggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgt

SEQ ID NO: 336 - DNA, 741 bp, Artificial Sequence
  Synthetic Polynucleotide
atggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgt

SEQ ID NO: 337 - DNA, 729 bp, Artificial Sequence
  Synthetic Polynucleotide
atggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgt

SEQ ID NO: 338 - DNA, 732 bp, Artificial Sequence
  Synthetic Polynucleotide
atggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgt

SEQ ID NO: 339 - DNA, 747 bp, Artificial Sequence
  Synthetic Polynucleotide
atggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgt

SEQ ID NO: 340 - DNA, 729 bp, Artificial Sequence
  Synthetic Polynucleotide
atggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgt

SEQ ID NO: 341 - DNA, 732 bp, Artificial Sequence
  Synthetic Polynucleotide
atggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgt

SEQ ID NO: 342 - DNA, 756 bp, Artificial Sequence
  Synthetic Polynucleotide
atggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgt

SEQ ID NO: 343 - DNA, 744 bp, Artificial Sequence; identical to SEQ ID NO: 260
  Synthetic Polynucleotide

SEQ ID NO: 344 - DNA, 735 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgt

SEQ ID NO: 345 - DNA, 735 bp, Artificial Sequence
  Synthetic Polynucleotide
atggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgt

SEQ ID NO: 346 - DNA, 732 bp, Artificial Sequence
  Synthetic Polynucleotide
atggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgt

SEQ ID NO: 347 - DNA, 729 bp, Artificial Sequence
  Synthetic Polynucleotide
atggatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgt

SEQ ID NO: 348 - DNA, 732 bp, Artificial Sequence
  Synthetic Polynucleotide
atggacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgt

SEQ ID NO: 349 - DNA, 744 bp, Artificial Sequence
  Synthetic Polynucleotide
atggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgt

SEQ ID NO: 350 - DNA, 753 bp, Artificial Sequence
  Synthetic Polynucleotide
atggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgt

SEQ ID NO: 351 - DNA, 759 bp, Artificial Sequence
  Synthetic Polynucleotide
atggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgt

SEQ ID NO: 352 - DNA, 756 bp, Artificial Sequence
  Synthetic Polynucleotide
atggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgt

SEQ ID NO: 353 - DNA, 726 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgt

SEQ ID NO: 354 - DNA, 732 bp, Artificial Sequence
  Synthetic Polynucleotide
atggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgt

SEQ ID NO: 355 - DNA, 732 bp, Artificial Sequence
  Synthetic Polynucleotide
atggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgt

SEQ ID NO: 356 - DNA, 735 bp, Artificial Sequence
  Synthetic Polynucleotide
atggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgt

SEQ ID NO: 357 - DNA, 729 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgt

SEQ ID NO: 358 - DNA, 786 bp, Artificial Sequence
  Synthetic Polynucleotide
atggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgt

SEQ ID NO: 359 - DNA, 777 bp, Artificial Sequence
  Synthetic Polynucleotide
atggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgt

SEQ ID NO: 360 - DNA, 699 bp, Artificial Sequence
  Synthetic Polynucleotide
atggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgt

SEQ ID NO: 361 - DNA, 747 bp, Artificial Sequence
  Synthetic Polynucleotide
atggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgt

SEQ ID NO: 362 - DNA, 720 bp, Artificial Sequence
  Synthetic Polynucleotide
atggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgt

SEQ ID NO: 363 - DNA, 723 bp, Artificial Sequence
  Synthetic Polynucleotide
atggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgt

SEQ ID NO: 364 - DNA, 723 bp, Artificial Sequence
  Synthetic Polynucleotide
atggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgt

SEQ ID NO: 365 - DNA, 756 bp, Artificial Sequence
  Synthetic Polynucleotide
atggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgt

SEQ ID NO: 366 - DNA, 744 bp, Artificial Sequence
  Synthetic Polynucleotide
atgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgt

SEQ ID NO: 367 - DNA, 729 bp, Artificial Sequence
  Synthetic Polynucleotide
atggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgt

SEQ ID NO: 368 - DNA, 741 bp, Artificial Sequence
  Synthetic Polynucleotide
atggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgt

SEQ ID NO: 369 - DNA, 768 bp, Artificial Sequence
  Synthetic Polynucleotide
atggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgt

SEQ ID NO: 370 - DNA, 741 bp, Artificial Sequence
  Synthetic Polynucleotide
atggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgt

SEQ ID NO: 371 - DNA, 750 bp, Artificial Sequence
  Synthetic Polynucleotide
atggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgt

SEQ ID NO: 372 - DNA, 735 bp, Artificial Sequence
  Synthetic Polynucleotide
atggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgt

SEQ ID NO: 373 - DNA, 738 bp, Artificial Sequence
  Synthetic Polynucleotide
atggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgt

SEQ ID NO: 374 - DNA, 729 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgt

SEQ ID NO: 375 - DNA, 765 bp, Artificial Sequence
  Synthetic Polynucleotide
atggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgt

SEQ ID NO: 376 - DNA, 735 bp, Artificial Sequence
  Synthetic Polynucleotide
atggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgt

SEQ ID NO: 377 - DNA, 726 bp, Artificial Sequence
  Synthetic Polynucleotide
atggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgt

SEQ ID NO: 378 - DNA, 741 bp, Artificial Sequence
  Synthetic Polynucleotide
atggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgt

SEQ ID NO: 379 - DNA, 738 bp, Artificial Sequence
  Synthetic Polynucleotide
atggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgt

SEQ ID NO: 380 - DNA, 744 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgt

SEQ ID NO: 381 - DNA, 732 bp, Artificial Sequence
  Synthetic Polynucleotide
atgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgt

SEQ ID NO: 382 - DNA, 726 bp, Artificial Sequence
  Synthetic Polynucleotide
atggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgt

SEQ ID NO: 383 - DNA, 759 bp, Artificial Sequence
  Synthetic Polynucleotide
atggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgt

SEQ ID NO: 384 - DNA, 744 bp, Artificial Sequence
  Synthetic Polynucleotide
atggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgt

SEQ ID NO: 385 - DNA, 747 bp, Artificial Sequence
  Synthetic Polynucleotide
atggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgt

SEQ ID NO: 386 - DNA, 747 bp, Artificial Sequence
  Synthetic Polynucleotide
atggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgt

SEQ ID NO: 387 - DNA, 747 bp, Artificial Sequence
  Synthetic Polynucleotide
atgcaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgt

SEQ ID NO: 388 - DNA, 729 bp, Artificial Sequence
  Synthetic Polynucleotide
atggacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgt

SEQ ID NO: 389 - DNA, 735 bp, Artificial Sequence
  Synthetic Polynucleotide
atggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgt

SEQ ID NO: 390 - DNA, 732 bp, Artificial Sequence
  Synthetic Polynucleotide
atggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgt

SEQ ID NO: 391 - DNA, 738 bp, Artificial Sequence
  Synthetic Polynucleotide
atggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgt

SEQ ID NO: 392 - DNA, 711 bp, Artificial Sequence
  Synthetic Polynucleotide
atggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgt

SEQ ID NO: 393 - DNA, 720 bp, Artificial Sequence
  Synthetic Polynucleotide
atggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgt

SEQ ID NO: 394 - DNA, 741 bp, Artificial Sequence
  Synthetic Polynucleotide
atggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgt

SEQ ID NO: 395 - DNA, 729 bp, Artificial Sequence
  Synthetic Polynucleotide
atggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgt

SEQ ID NO: 396 - DNA, 732 bp, Artificial Sequence
  Synthetic Polynucleotide
atggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgt

SEQ ID NO: 397 - DNA, 735 bp, Artificial Sequence
  Synthetic Polynucleotide
atggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgt

SEQ ID NO: 398 - DNA, 750 bp, Artificial Sequence
  Synthetic Polynucleotide
atggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtacgcgt

SEQ ID NO: 399 - DNA, 774 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgagcagaaactgatctcggaagaggatctgtga

SEQ ID NO: 400 - DNA, 756 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacgccgcctaccctacttttggcggagggaccaaggttgagatcaaacggggcggaggcggaagtggaggcggaggatctggcggcggaggctctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggcggtgtactactgcgccagagagagttggccaatggacgtatggggccagggaacaactgtcaccgtctcctcaacgcgtgagcagaaactgatctcggaagaggatctgtga

SEQ ID NO: 401 - DNA, 771 bp, Artificial Sequence
  Synthetic Polynucleotide
atggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaaaggcggaggcggaagtggaggcggaggatctggcggcggaggctctcaaatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctgtga

SEQ ID NO: 402 - DNA, 762 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagaatctcctggcctttcacttttggcggagggaccaaggttgagatcaaaggcggaggcggaagtggaggcggaggatctggcggcggaggctctgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggcggtgtactactgcgcaagagccgagatgggagccgtattcgacatatggggtcagggtacaatggtcaccgtctcctcaacgcgtgagcagaaactgatctcggaagaggatctgtga

SEQ ID NO: 403 - DNA, 777 bp, Artificial Sequence
  Synthetic Polynucleotide
atggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagacacgtctggcctcctacttttggcggagggaccaaggttgagatcaaacggggcggaggcggaagtggaggcggaggatctggcggcggaggctctcagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagaggcaggggatatgcaaccagcttagccttcgatatctggggtcagggtacaatggtcaccgtctcctcaacgcgtgagcagaaactgatctcggaagaggatctgtga

SEQ ID NO: 404 - DNA, 792 bp, Artificial Sequence
  Synthetic Polynucleotide
atggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagggactcggcctccctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgccagagacggtacttatctaggtggtctctggtacttcgacttatgggggagaggtaccttggtcaccgtctcctcaacgcgtgagcagaaactgatctcggaagaggatctgtga

SEQ ID NO: 405 - DNA, 807 bp, Artificial Sequence
  Synthetic Polynucleotide
atggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgcccacactcctttcacttttggcggagggaccaaggttgagatcaaacggggcggaggcggaagtggaggcggaggatctggcggcggaggctctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagaactcctgaatactcctccagcatatggcactattactacggcatggacgtatggggccagggaacaactgtcaccgtctcctcaacgcgtgagcagaaactgatctcggaagaggatctgtga

SEQ ID NO: 406 - DNA, 780 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatagcgcatccaccagggccactggtatcccagccaggttcagtggcagtgggtctgggacagagttcactctcaccatcagcagcctgcagtctgaagattttgcagtttattactgtcagcagcaccacgtctggcctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgtcaaggggccgttgcaggagccgccatacgattatggaatggacgtatggggccagggaacaactgtcaccgtctcctcaacgcgtgagcagaaactgatctcggaagaggatctgtga

SEQ ID NO: 407 - DNA, 768 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattctactacccttggacttttggcggagggaccaaggttgagatcaaacggggcggaggcggaagtggaggcggaggatctggcggcggaggctctgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcaaccattagtagtagtagtagtaccatatactacgcagactctgtgaagggccgattcaccatctccagagacaatgccaagaactcactgtatctgcaaatgaacagcctgagagctgaggacacggcggtgtactactgcgccagaggttctcaggagcacctgattttcgattattggggacagggtacattggtcaccgtctcctcaacgcgtgagcagaaactgatctcggaagaggatctgtga

SEQ ID NO: 408 - DNA, 783 bp, Artificial Sequence
  Synthetic Polynucleotide
atggacatccagatgacacagagccctagcagcctgtctgccagcgtgggagacagagtgaccatcacctgtaccgccagcagcagagtgtccagcagctacctgcactggttccagcagaagcctggcaaggcccctaagctgctgatctacagcaccagcaatctggcctctggcgtgcccagcagattttctggctctggcagcggcaccgacttcaccctgacaatatctagcctccagcctgaggacttcgccacctactactgccaccagtaccacagaagcccctacacattcggccagggcaccaaggtggaaatcaagagaggcggaggcggaagtggaggcggaggatctggcggcggaggctctgaagttcagctggttgaatctggcggcggactggttcaacctggcggatctctgagactgagctgtgccgcctctggctacgccttcagcaacagctggatcaactgggtccgacaggcccctggcaaaggactggaatgggtcggacaaatctaccccggcgactacgacaccaactacaacggcaagttcaagggcagattcaccatcagccgggacaagagcaagaacaccgcctacctccagatgaactccctgagagccgaggacaccgccgtgtactattgtgctagaggcggctccatctactacggcaacctgggcttcttcgacgtgtggggacagggcacactggtcacagtctcttctacgcgtgagcagaaactgatctcggaagaggatctgtga

SEQ ID NO: 409 - DNA, 753 bp, Artificial Sequence
  Synthetic Polynucleotide
atggacatccagatgacacagagccctagcagcctgtctgccagcgtgggagacagagtgaccatcacatgtagcgccagcagcagcgtgacctacatgtactggtatcagcagaagcccggcaaggcccctaagctgctgatctacgacaccagcaatctggcctctggcgtgcccagcagattttctggctctggcagcggcaccgactacaccctgacaatatctagcctccagcctgaggacttcgccacctactactgccagcagtggtccaactatcccctgacattcggccagggcaccaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacagcttcatcgagtacaccatcaactgggtccgacaggcccctggacaaggcctggaatggatcggcaacatcgacccctactacggcacaacctactacaaccagatgttcaccggcagagccacactgaccgtggacacctctatcagcaccgcctacatggaactgagccggctgagatccgatgacaccgccgtgtactattgtgccagaggcagcgcctggtttccctattggggacagggaaccctggtcaccgttagctctacgcgtgagcagaaactgatctcggaagaggatctgtga

SEQ ID NO: 410 - DNA, 753 bp, Artificial Sequence
  Synthetic Polynucleotide
atggagatcgtgctgacacagagcccttctagcctgtctgccagcgtgggcgacagagtgaccatcacatgtagagccagcgagaacatctacagctacctggcctggtatcagcagaagcctggcaaggcccctaagctgctgatctacaacaccaagacactcggcgagggcgtgcccagcagattttctggttctggcagcggcaccgacttcaccctgaccatatctagcctgcagcctgaggacttcgccacctactactgccagcaccactacggcacccctttcacatttggccctggcaccaaggtggacatcaaaggcggaggcggaagtggaggcggaggatctggcggcggaggctctcaagttcagctggttcagagcggagccgaagtgaagaaacctggggcctctgtgaaggtgtcctgcaaggccagcggctacaccttcagcgactattgggtgcactgggtccgacaggctccaggacaaggactggaatggatgggagccatcgacggcagcgataccttcaacgattacagccagaaattcaaaggccgcgtgaccatgaccagagacaccagcatcagcaccgcctacatggaactgagccggctgagatccgatgacaccgccgtgtactattgtgccagaggcggcctgctgcagtattggggacagggaacactggtcaccgtgtcctctacgcgtgagcagaaactgatctcggaagaggatctgtga

SEQ ID NO: 411 - DNA, 765 bp, Artificial Sequence
  Synthetic Polynucleotide
atggagatcgtgctgacacagtctcccgccacactgtcactgtctccaggcgaaagagccacactgagctgtagcgccagcagcagcgtgtcctacatgcactggtatcagcagaagcccggacaggcccctagactgctgatctacgataccagcaagctggcctctgacatccccgccagattttctggcagcggctctggcaccgatttcaccctgaccataagcagcctggaacctgaggacttcgccgtgtactactgtcagcagggcagcgtgtaccccttcacatttggcggcggaacaaaggtggaaatcaaaggcggaggcggaagtggaggcggaggatctggcggcggaggctctcaagttcagctgcaagagtctggccctggcctggttaagcctagcggaacactgagcctgacctgtgctgtgtctggcggcagcatcagcacatctggcatgggcgttggctgggtccgacagcctcctggaaaaggcctggaatggatcggccacatttggtgggacgacgacaagcggtacaaccccgctctgaagtccagagtgaccatcagcgtggacaagagcaagaaccagttcagcctgcggctgagcagcgtgacagctgcagataccgccgtgtattattgcgcccggatggaactgtggtcctactacttcgactactggggcaagggcaccaccgtgactgtctcttctacgcgtgagcagaaactgatctcggaagaggatctgtga

SEQ ID NO: 412 - DNA, 777 bp, Artificial Sequence
  Synthetic Polynucleotide
atggacatccagatgacccagaccacaagcagcctgtctgccagcctgggcgacagagtgaccatctcttgtagagccagccaggacatcagcaactacctgaactggtatcagcagaaacccgacggcaccgtgaagctgctgatctactacaccagcatcctgcacagcggcgtgcccagcagattttctggctctggcagcggcaccgactacagcctgaccatcagcaatctggaacaagaggacttcgctacctacttctgccagcaaggcaacaccctgccttggacatttggcggaggcaccaagctggaaatcaaagctggcggaggcggaagtggaggcggaggatctggcggcggaggctctgaagtgcaactggttgaatctggcggcggactggttaagcctggcggatctctgaagctgagctgtgccgcctctggcttcgccttcagcatctacgatatgagctgggtccgacagacccctgagaagagactggaatgggtcgcctacatctctagcggcggagggacctactatcccgacacagtgaagggcagattcaccatctccagagacaacgccaagaacaccctgtacctccagatgagcagcctgaagtccgaggacaccgccatgtactactgcgccagacacagcggctatggcacacattggggagtgctgtttgcctactggggccagggaacactggtcacagtttctgctacgcgtgagcagaaactgatctcggaagaggatctgtga

SEQ ID NO: 413 - DNA, 777 bp, Artificial Sequence
  Synthetic Polynucleotide
atggatattcaactgacacaatcccccagctcactcagcgccagcgtgggggacagggttagctttacctgtcaagcctctcaggatataaataactttctgaactggtatcaacagaagcctgggaaggcgcccaaactcctgatctatgatgcgtccaacctggaaactggcgtgccttcacgctttagcggctctggcagtggtacagacttcacttttaccatctcttcacttcagccggaggacatcgccacatattactgtcaacagtacggaaacttgccctttacttttggaggcggcaccaaagttgaaatcaaaagaggcggaggcggaagtggaggcggaggatctggcggcggaggctctcaggtccaactgcaagaaagcggacccggactggtgaagccttctgagacacttagtctgacgtgcacggtcagtggcggctccatctcctcctattattggtcatggatacgacaacccccaggtaagggcctggaatggattggctatatctactattcaggaagcacgaactacaatcccagcctgaagtcccgagtgacaatttcagtagataccagtaaaaaccagttcagtcttaaactgtcaagcgtgacagctgccgacaccgctgtgtattactgcgtctcactggtgtattgtggaggggattgttatagcgggttcgattattggggacagggaaccctggtgactgtatcttccacgcgtgagcagaaactgatctcggaagaggatctgtga

SEQ ID NO: 414 - DNA, 783 bp, Artificial Sequence
  Synthetic Polynucleotide
atggatatccagctcactcaaagcccctctagtctctctgcctcagtgggggatcgggtcagttttacttgtcaagcttcacaggatatcaacaacttccttaattggtatcagcagaagccaggaaaagcacccaagctgctcatctatgatgcctcaaatttggagacgggtgttcccagtcgattctctgggtcagggtccgggaccgactttacgtttacgatctcctctctgcagcccgaagacatcgccacatactattgtcaacagtacggcaacttgcctttcacatttgggggcgggactaaggttgaaatcaagaggggcggaggcggaagtggaggcggaggatctggcggcggaggctctcaggtacagctgcaggaatctgggcccggacttgtcaagccaagtcagacactttctcttacatgtaccgtgagcggcggaagtataagcagtggaggcttttactggtcttggatacggcagcacccaggcaaaggcttggagtggattggatacattcatcattcaggatctacacactataatccatcccttaagtcccgggtcaccattagcattgatacgtctaagaatctgttcagtctcaggctgtcctccgtcactgctgccgacacagccgtgtactactgcgcctccttggtttactgcggaggcgactgttatagcggctttgattattgggggcaggggaccctcgtaaccgtgagctctacgcgtgagcagaaactgatctcggaagaggatctgtga

SEQ ID NO: 415 - DNA, 783 bp, Artificial Sequence
  Synthetic Polynucleotide
atggacttcgtgatgacacagagccctctgagcctgcctgtgacacctggcgaacctgccagcatcagctgtagaagcagccagagcatcgtgcacagcaacggcaacacctacctggaatggtatctccagaagcctggacagagcccacagctgctgatctacaaggtgtccaacagattcagcggcgtgcccgacagattttctggcagcggctctggcaccgacttcaccctgaagattagcagagtggaagccgaggacgtgggcgtgtactactgcttccaaggctctcacgtgcccctgacctttggacagggcaccaagctggaaatcaagagaggcggaggcggaagtggaggcggaggatctggcggcggaggctctgaagtgcagctggttgaaagcggagccgaagtgaagaaacctggggcctctgtgaaggtgtcctgcaaggccagcggctacacctttaccagctactggattcactgggtccgacaggcccctggacaaggacttgagtggatgggcgagaacgacccctccaacggcaggaccaactacaacgagaagttcaagaaccgcgtgaccctgaccgtggacaccagcatctctaccgcctacatggaactgagccggctgagatccgatgacaccgccgtgtactattgcgccagaggacccaactacttttacagcatggactactggggccagggcacaatggtcaccgttagctctacgcgtgagcagaaactgatctcggaagaggatctgtga

SEQ ID NO: 416 - DNA, 774 bp, Artificial Sequence
  Synthetic Polynucleotide
atggagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggcggaggcggaagtggaggcggaggatctggcggcggaggctctcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcacgcgtgagcagaaactgatctcggaagaggatctgtga

SEQ ID NO: 417 - DNA, 774 bp, Artificial Sequence
  Synthetic Polynucleotide
atgcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggcggaggcggaagtggaggcggaggatctggcggcggaggctctgagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcacgcgtgagcagaaactgatctcggaagaggatctgtga

SEQ ID NO: 418 - DNA, 792 bp, Artificial Sequence
  Synthetic Polynucleotide
atggacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggcggaggcggaagtggaggcggaggatctggcggcggaggctctcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcacgcgtgagcagaaactgatctcggaagaggatctgtga

SEQ ID NO: 419 - DNA, 792 bp, Artificial Sequence
  Synthetic Polynucleotide
atgcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggcggaggcggaagtggaggcggaggatctggcggcggaggctctgacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggacgcgtgagcagaaactgatctcggaagaggatctgtga

SEQ ID NO: 420 - DNA, 762 bp, Artificial Sequence
  Synthetic Polynucleotide
atggacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggcggaggcggaagtggaggcggaggatctggcggcggaggctctcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctacgcgtgagcagaaactgatctcggaagaggatctgtga

SEQ ID NO: 421 - DNA, 762 bp, Artificial Sequence
  Synthetic Polynucleotide
atgcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggcggaggcggaagtggaggcggaggatctggcggcggaggctctgacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaacgcgtgagcagaaactgatctcggaagaggatctgtga

SEQ ID NO: 422 - DNA, 739 bp, Artificial Sequence
  Synthetic Polynucleotide
atggagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtacgcgtgagcagaaactgatctcggaagaggatctgtga

SEQ ID NO: 423 - DNA, 739 bp, Artificial Sequence; identical to SEQ ID NO: 422
  Synthetic Polynucleotide

SEQ ID NO: 424 - DNA, 751 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtacgcgtgagcagaaactgatctcggaagaggatctgtga

SEQ ID NO: 425 - DNA, 751 bp, Artificial Sequence; identical to SEQ ID NO: 424
  Synthetic Polynucleotide

SEQ ID NO: 426 - DNA, 777 bp, Artificial Sequence
  Synthetic Polynucleotide
atggacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggcggaggcggaagtggaggcggaggatctggcggcggaggctctcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctacgcgtgagcagaaactgatctcggaagaggatctgtga

SEQ ID NO: 427 - DNA, 777 bp, Artificial Sequence
  Synthetic Polynucleotide
atgcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggcggaggcggaagtggaggcggaggatctggcggcggaggctctgacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaacgcgtgagcagaaactgatctcggaagaggatctgtga

SEQ ID NO: 428 - DNA, 786 bp, Artificial Sequence
  Synthetic Polynucleotide
atgcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggcggaggcggaagtggaggcggaggatctggcggcggaggctctcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtacgcgtgagcagaaactgatctcggaagaggatctgtga

SEQ ID NO: 429 - DNA, 786 bp, Artificial Sequence
  Synthetic Polynucleotide
atgcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggcggaggcggaagtggaggcggaggatctggcggcggaggctctcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaacgcgtgagcagaaactgatctcggaagaggatctgtga

SEQ ID NO: 430 - DNA, 762 bp, Artificial Sequence
  Synthetic Polynucleotide
atggacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggcggaggcggaagtggaggcggaggatctggcggcggaggctctcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctacgcgtgagcagaaactgatctcggaagaggatctgtga

SEQ ID NO: 431 - DNA, 762 bp, Artificial Sequence
  Synthetic Polynucleotide
atgcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggcggaggcggaagtggaggcggaggatctggcggcggaggctctgacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaacgcgtgagcagaaactgatctcggaagaggatctgtga

SEQ ID NO: 432 - DNA, 786 bp, Artificial Sequence
  Synthetic Polynucleotide
atggacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggcggaggcggaagtggaggcggaggatctggcggcggaggctctcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctacgcgtgagcagaaactgatctcggaagaggatctgtga

SEQ ID NO: 433 - DNA, 786 bp, Artificial Sequence
  Synthetic Polynucleotide
atgcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggcggaggcggaagtggaggcggaggatctggcggcggaggctctgacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaacgcgtgagcagaaactgatctcggaagaggatctgtga

SEQ ID NO: 434 - DNA, 771 bp, Artificial Sequence
  Synthetic Polynucleotide
atggacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggcggaggcggaagtggaggcggaggatctggcggcggaggctctgaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctacgcgtgagcagaaactgatctcggaagaggatctgtga

SEQ ID NO: 435 - DNA, 771 bp, Artificial Sequence
  Synthetic Polynucleotide
atggaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggcggaggcggaagtggaggcggaggatctggcggcggaggctctgacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggacgcgtgagcagaaactgatctcggaagaggatctgtga

SEQ ID NO: 436 - DNA, 762 bp, Artificial Sequence
  Synthetic Polynucleotide
atggacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctacgcgtgagcagaaactgatctcggaagaggatctgtga

SEQ ID NO: 437 - DNA, 762 bp, Artificial Sequence
  Synthetic Polynucleotide
atggaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggcggaggcggaagtggaggcggaggatctggcggcggaggctctgacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaacgcgtgagcagaaactgatctcggaagaggatctgtga

SEQ ID NO: 438 - DNA, 762 bp, Artificial Sequence
  Synthetic Polynucleotide
atggacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggcggaggcggaagtggaggcggaggatctggcggcggaggctctgaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctacgcgtgagcagaaactgatctcggaagaggatctgtga

SEQ ID NO: 439 - DNA, 762 bp, Artificial Sequence
  Synthetic Polynucleotide
atggaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggcggaggcggaagtggaggcggaggatctggcggcggaggctctgacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttacgcgtgagcagaaactgatctcggaagaggatctgtga

SEQ ID NO: 440 - DNA, 786 bp, Artificial Sequence
  Synthetic Polynucleotide
atgcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggcggaggcggaagtggaggcggaggatctggcggcggaggctctcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctacgcgtgagcagaaactgatctcggaagaggatctgtga

SEQ ID NO: 441 - DNA, 786 bp, Artificial Sequence
  Synthetic Polynucleotide
atgcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggcggaggcggaagtggaggcggaggatctggcggcggaggctctcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcacgcgtgagcagaaactgatctcggaagaggatctgtga

SEQ ID NO: 442 - DNA, 807 bp, Artificial Sequence
  Synthetic Polynucleotide
atggacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggcggaggcggaagtggaggcggaggatctggcggcggaggctctgaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctacgcgtgagcagaaactgatctcggaagaggatctgtga

SEQ ID NO: 443 - DNA, 807 bp, Artificial Sequence
  Synthetic Polynucleotide
atggaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggcggaggcggaagtggaggcggaggatctggcggcggaggctctgacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttacgcgtgagcagaaactgatctcggaagaggatctgtga

SEQ ID NO: 444 - DNA, 723 bp, Artificial Sequence
  Synthetic Polynucleotide
atggtcgtgatgacccagacccctctgagcctgagcgtgacactgggacagcctgccagcatcagctgcaagagcagccagagcctgctgcacagcgacggcaagacctacctgaactggctgcagcagaggccaggccagagccctcggagactgatctacctggtgtccaagctggacagcggcgtgcccgatagattttccggctctggcagcggcaccgacttcaccctgaagatcagccgggtggaagccgaggacgtgggcatctactactgttggcagggcacccacctgtggacctttggcggcggaacaaaggtggaaatcaagggcggaggcggaagtggaggcggaggatctggcggcggaggctctgaagtgcacctggtggaaagcggcggaggactggtgcagccagggggatctctgagactgtcttgtgccgccagcggcttcaccttcagcagatacggcatgagctgggtgcgccaggcccctggaaaaggactggaactggtggctatgatgaagaccaagggcggcagaacctactaccccgacagcgtgaagggccggttcaccatctcccgggacaacgccaagaacagcctgtacctgcagatgaactccctgcgggccgaggacaccgccatctactattgtgcctccgacggctactactggggccagggaacaaccgtcaccgtgtcctctacgcgt

SEQ ID NO: 445 - DNA, 732 bp, Artificial Sequence
  Synthetic Polynucleotide
atggagatcgtgctgacacagtctcccgccacactgtcactgtctccaggcgaaagagccacactgagctgtagcgccaccagcagcgtgtcctacatgcactggtatcagcagaagcccggcaaggcccctaagcggtggatctacgataccagcaaactggcctctggcgtgcccagcagattttctggctctggcagcggcaccgagttcaccctgacaatatctagcctccagcctgaggacttcgccacctactactgccagcagtggtccagcaatcccctgacctttggacagggcaccaagctggaaatcaaaggcggaggcggaagtggaggcggaggatctggcggcggaggctctcaagttcagctggttcagtctggggccgaagtgaagaaacctggggcctctgtgaaggtgtcctgcaaggccagcggctacaagttcaccagctacgtgatgcactgggtccgacaggctccaggacaaggactggaatggatcggctacatcaacccctacaacgacgtgaccaagtacaacgagaagttcaagggcagagtgaccatcaccgccgacaagagcacaagcaccgcctacatggaactgagcagcctgagaagcgaggacaccgccgtgcactattgtgccagaggcagctactacgactacgacggctttgtgtattggggccagggcaccctggtcaccgtttcttctacgcgt

SEQ ID NO: 446 - DNA, 747 bp, Artificial Sequence
  Synthetic Polynucleotide
atggacatcgtgatgacacagagccctgatagcctggccgtgtctctgggagagagagccaccatcaactgcaagagcagccagagcctgctgaacagccggaccagaaagaactacctggcctggtatcagcagaagcccggacagtctcccaagctgctgatctactggaccagcaccagaaagtccggcgtgcccgatagattttctggctctggcagcggcaccgacttcaccctgacaatttctagcctgcaagccgaggacgtggccgtgtactactgcaagcagagcttcatcctgcggacctttggccagggcaccaaggtggaaatcaaaggcggaggcggaagtggaggcggaggatctggcggcggaggctctgaagttcagctggttcagagcggagccgaagtgaagaaacctggggcctctgtgaaggtgtcctgcaaggcttccggcttcaccttcaccagctactacatccactgggtccgacaggcccctggacaaggactggaatggatcggctggatctaccccgagaacgacaacaccaagtacaacgagaagttcaaggaccgcgtgaccatcaccgccgataccagcacaagcaccgcctacctggaactgagcagcctgagaagcgaggacaccgccgtgtattattgcgccagagatgcctacagccggtactacttcgactactggggccagggaaccctggtcacagtctcttctacgcgt

SEQ ID NO: 447 - DNA, 756 bp, Artificial Sequence
  Synthetic Polynucleotide
atggacatcgtgatgacacagagccctctgagcctgcctgtgacacctggcgaacctgccagcatcagctgtagaagcagccagagactgctgagcagctacggccacacatacctgcactggtatctccagaagcctggacagagcccacagctgctgatctacgaggtgtccaacagattcagcggcgtgcccgatagattttccggctctggcagcggcaccgacttcaccctgaagattagcagagtggaagccgaggacgtgggcgtgtactactgtagccagagcacacacgtgcccctgacctttggacagggcaccaaggtggaaatcaaaggcggaggcggaagtggaggcggaggatctggcggcggaggctctgaagtgcagctggttgaatctggcggcggactggttaagcctggcggatctctgagactgagctgtgccgccagcggctacaccttcagcaattactggatcggctgggtccgacaggcccctggaaaaggactggaatggatcggcgacatctaccctggcggcaactacatcagaaacaacgagaagttcaaggacaagaccacactgagcgccgacaccagcaagaacacagcctacctccagatgaacagcctgaaaaccgaggacaccgccgtgtactattgcggcagcagcttcggcagcaactacgtgttcgcctggttcacctattggggccagggcacactggtcaccgttagctctacgcgt

SEQ ID NO: 448 - DNA, 750 bp, Artificial Sequence
  Synthetic Polynucleotide
atggacatcgtgatgtctcagagccctagcagcctggctgtgtccgctggcgagaaagtgaccatgagctgcaagagcagccagagcctgttcaacagccggaccagaaagaactacctggcctggtatcagcagaagcccggacagtctcccaagctgctgatctactgggccagcgccagagatagcggagtgcctgctagattcacaggcagcggcagcgagacatacttcaccctgaccatcagcagagtgcaggccgaggatctggccgtgtactactgtatgcagagcttcaacctgcggaccttcggcggaggcaccaagctggaaatcaaaggcggaggcggaagtggaggcggaggatctggcggcggaggctctgaagtgaacctggttgaatccggcggaggactggttcagcctggcggatctctgagactgagctgtgccaccagcggcttcaccttcaccgacaactacatgagctgggtccgacagcctcctggcaaagctctggaatggctgggcttcatcagaaacaaggccaacggctacaccaccgactacagcgcctctgtgcggggcagattcaccatctccagagacaacagccagtccatcctgtacctccagatgaacgccctgagagccgaggatagcgccacctactactgtgccagagatgtgggcagcaactacttcgactattggggccagggcaccacactgaccgttagctctacgcgt

SEQ ID NO: 449 - DNA, 753 bp, Artificial Sequence
  Synthetic Polynucleotide
atggacatcgtgatgacacagagccctgatagcctggccgtgtctctcggcgagcgcgtgacaatgaattgcaagagcagccagagcctgctgtactccaccaaccagaagaactacctggcctggtatcagcagaagcccggacagtctcccaagctgctgatctactgggccagcaccagagaaagcggcgtgcccgatagattttctggctctggcagcggcaccgacttcaccctgacaatcagttctgtgcaggccgaggacgtggccgtgtactactgccagcagtattacagctaccggaccttcggcggaggcaccaagctggaaatcaaaggcggaggcggaagtggaggcggaggatctggcggcggaggctctcaagttcagctccagcagtctggccccgagtggaaacctggcgcttctgtgaagatgagctgcaaggccagcggctacaccttcaccagctacgtgatccactgggtccgacagaagcctggccaaggactggattggatcggctacatcaacccctacaacgacggcaccgattacgacgagaagttcaagggcaaagccacactgaccagcgacaccagcacaagcaccgcctacatggaactgagcagcctgagaagcgaggacaccgccgtgtattattgcgccagagagaaggacaactacgccaccggcgcttggtttgcctattggggccagggaacactggtcaccgttagctctacgcgt

SEQ ID NO: 450 - DNA, 741 bp, Artificial Sequence
  Synthetic Polynucleotide
atggacatccagatgacacagagccctagcagcctgtctgccagcgtgggagacagagtgaccatcacctgtagagccagccaggacatcagaaactacctgaactggtatcagcagaagcccggcaaggcccctaagctgctgatctactacaccagcagactggaaagcggcgtgcccagcagattttctggcagcggctctggcaccgactacaccctgacaatatccagcctccagcctgaggacttcgccacctactattgccagcagggcaacaccctgccttggacatttggccagggcaccaaggtggaaatcaaaggcggaggcggaagtggaggcggaggatctggcggcggaggctctgaagtgcagctggttgaatcaggtggcggcctggttcaacctggcggatctctgagactgagctgtgccgccagcggctacagctttaccggctacaccatgaactgggtccgacaggcccctggcaaaggactggaatgggtcgccctgattaacccctacaagggcgtgtccacctacaaccagaagttcaaggacaggttcaccatcagcgtggacaagagcaagaacaccgcctacctccagatgaactccctgagagccgaggacaccgccgtgtactattgtgccagaagcggctactacggcgacagcgactggtactttgatgtgtggggccagggaaccctggtcaccgtttcttctacgcgt

SEQ ID NO: 451 - DNA, 747 bp, Artificial Sequence
  Synthetic Polynucleotide
atgagcacaggatctcaggtgcagctccagcagtctggccctgagcttgtgaaacctggcgcttccgtgaagatgagctgcaaggccagcggctacaccttcaccgactatgtgattaactggggcaagcagcggagcggccaaggactggaatggatcggcgaaatctaccctggcagcggcaccaactactacaacgagaagttcaaggccaaggccacactgaccgccgacaagagcagcaatatcgcctacatgcagctgagcagcctgaccagcgaagatagcgccgtgtacttctgcgccagaagaggcagatacggcctgtacgctatggactattggggccagggcaccagcgtgacagtgtcatctggcggaggcggaagtggaggcggaggatctggcggcggaggctctgacatccagatgacccagacaaccagcagcctgtctgccagcctgggcgatagagtgaccatcagctgtagagccagccaggacatcagcaactacctgaactggtatcagcagaaacccgacggcaccgtgaagctgctgatctactacaccagcagactgcacagcggcgtgcccagcagattttctggctctggaagcggcacagattactccctgaccatcaacaacctggaacaagaggacattgccacctacttttgccagcaaggcaacacccggccttggacatttggcggaggcaccaagctggaaatcaagacgcgt

SEQ ID NO: 452 - DNA, 732 bp, Artificial Sequence
  Synthetic Polynucleotide
atgcagatcgtgctgacacagagccctgccatcatgagcgcttccccaggcgagaaagtgaccatgacctgtagcgccacaagcagcgtgtcctacatgcactggtatcagcagaagtccggcacaagccccaagcggtggatctacgataccagcaaactggcctctggcgtgcccgctagattttctggctctggcagcggcaccagctacagcctgacaatcagcagcatggaagccgaggatgccgccacctactactgccagcagtggtccagcaatcccctgacatttggagccggcaccaagctggaactgaaaggcggaggcggaagtggaggcggaggatctggcggcggaggctctgaagttcagctccagcagtctggccccgagcttgtgaaacctggcgcttccgtgaagatgagctgcaaggccagcggctacaagttcacctcctacgtgatgcactgggtcaagcagaaacccggccagggccttgagtggatcggctacatcaacccctacaacgacgtgaccaagtacaacgagaagttcaagggcaaagccacactgaccagcgacaagagcagcagcaccgcctacatggaactgagcagcctgacctctgaggacagcgccgtgcactattgtgccagaggcagctactacgactacgacggctttgtgtattggggccagggcaccctggttaccgtttctgctacgcgt

SEQ ID NO: 453 - DNA, 735 bp, Artificial Sequence
  Synthetic Polynucleotide
atggacatccagatgacacagagccctgccagccagtctgcctctctgggagagtctgtgaccatcacctgtctggcctctcagaccatcggaacatggctggcctggtatcagcagaagcctggcaagtctccccagctgctgatctacgccgctacatctctggctgatggcgtgcccagcagattttctggcagcggctccggcaccaagttcagcctgaagatcagaaccctccaggccgaggacttcgtgtcctactattgccagcagctgtactccaagccttacacctttggcggaggcaccaagctggaaatcaagagaggcggaggcggaagtggaggcggaggatctggcggcggaggctctgaagttcagctgcaacagagcggagccgagctggttaagcctggcgcttctgtgaagctgagctgtacccctagcggcttcaacgtgaaggacacctacatccactgggtcaagcagcggcctaagcagggcctcgaatggatcggaagaatcgaccctagcgacggcgacattaagtacgaccccaagttccagggcaaagccaccatcaccgccgacaccagcagcaacacagtgtctctccagctgagcagcctgaccagcgaagataccgccgtgtactattgcgcccgttggttcggcgattacggggccatgaattattggggccagggcaccagcgtgaccgtgtcatctacgcgt

SEQ ID NO: 454 - skipped

SEQ ID NO: 455 - DNA, 741 bp, Artificial Sequence
  Synthetic Polynucleotide
atggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctctaaggatgagctg

SEQ ID NO: 456 - DNA, 741 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtaaggatgagctg

SEQ ID NO: 457 - DNA, 741 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtaaggatgagctg

SEQ ID NO: 458 - DNA, 744 bp, Artificial Sequence
  Synthetic Polynucleotide
atggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtaaggatgagctg

SEQ ID NO: 459 - DNA, 765 bp, Artificial Sequence
  Synthetic Polynucleotide
atggacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtaaggatgagctg

SEQ ID NO: 460 - DNA, 816 bp, Artificial Sequence
  Synthetic Polynucleotide
atgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctaaggatgagctg

SEQ ID NO: 461 - DNA, 747 bp, Artificial Sequence
  Synthetic Polynucleotide
atggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtaaggatgagctg

SEQ ID NO: 462 - DNA, 744 bp, Artificial Sequence
  Synthetic Polynucleotide
atgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtaaggatgagctg

SEQ ID NO: 463 - DNA, 762 bp, Artificial Sequence
  Synthetic Polynucleotide
atgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctaaggatgagctg

SEQ ID NO: 464 - DNA, 777 bp, Artificial Sequence
  Synthetic Polynucleotide
atgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctaaggatgagctg

SEQ ID NO: 465 - DNA, 738 bp, Artificial Sequence
  Synthetic Polynucleotide
atggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctaaggatgagctg

SEQ ID NO: 466 - DNA, 768 bp, Artificial Sequence
  Synthetic Polynucleotide
atggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctaaggatgagctg

SEQ ID NO: 467 - DNA, 741 bp, Artificial Sequence
  Synthetic Polynucleotide
atggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtaaggatgagctg

SEQ ID NO: 468 - DNA, 753 bp, Artificial Sequence
  Synthetic Polynucleotide
atggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaaaggatgagctg

SEQ ID NO: 469 - DNA, 747 bp, Artificial Sequence
  Synthetic Polynucleotide
atggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcaaggatgagctg

SEQ ID NO: 470 - DNA, 747 bp, Artificial Sequence
  Synthetic Polynucleotide
atggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctaaggatgagctg

SEQ ID NO: 471 - DNA, 750 bp, Artificial Sequence
  Synthetic Polynucleotide
atgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctaaggatgagctg

SEQ ID NO: 472 - DNA, 744 bp, Artificial Sequence
  Synthetic Polynucleotide
atgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctaaggatgagctg

SEQ ID NO: 473 - DNA, 777 bp, Artificial Sequence
  Synthetic Polynucleotide
atgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctaaggatgagctg

SEQ ID NO: 474 - DNA, 744 bp, Artificial Sequence
  Synthetic Polynucleotide
atggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctaaggatgagctg

SEQ ID NO: 475 - DNA, 747 bp, Artificial Sequence
  Synthetic Polynucleotide
atggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtaaggatgagctg

SEQ ID NO: 476 - DNA, 750 bp, Artificial Sequence
  Synthetic Polynucleotide
atggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctaaggatgagctg

SEQ ID NO: 477 - DNA, 750 bp, Artificial Sequence
  Synthetic Polynucleotide
atggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcaaggatgagctg

SEQ ID NO: 478 - DNA, 750 bp, Artificial Sequence; identical to SEQ ID NO: 477
  Synthetic Polynucleotide

SEQ ID NO: 479 - DNA, 750 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctaaggatgagctg

SEQ ID NO: 480 - DNA, 756 bp, Artificial Sequence
  Synthetic Polynucleotide
atggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcaaggatgagctg

SEQ ID NO: 481 - DNA, 747 bp, Artificial Sequence
  Synthetic Polynucleotide
atggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctaaggatgagctg

SEQ ID NO: 482 - DNA, 756 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctaaggatgagctg

SEQ ID NO: 483 - DNA, 750 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctaaggatgagctg

SEQ ID NO: 484 - DNA, 747 bp, Artificial Sequence
  Synthetic Polynucleotide
atggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctaaggatgagctg

SEQ ID NO: 485 - DNA, 777 bp, Artificial Sequence
  Synthetic Polynucleotide
atgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccaaggatgagctg

SEQ ID NO: 486 - DNA, 753 bp, Artificial Sequence
  Synthetic Polynucleotide
atgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcaaggatgagctg

SEQ ID NO: 487 - DNA, 747 bp, Artificial Sequence; identical to SEQ ID NO: 484
  Synthetic Polynucleotide

SEQ ID NO: 488 - DNA, 744 bp, Artificial Sequence
  Synthetic Polynucleotide
atggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctaaggatgagctg

SEQ ID NO: 489 - DNA, 750 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctaaggatgagctg

SEQ ID NO: 490 - DNA, 744 bp, Artificial Sequence
  Synthetic Polynucleotide
atggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctaaggatgagctg

SEQ ID NO: 491 - DNA, 759 bp, Artificial Sequence
  Synthetic Polynucleotide
atggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcaaggatgagctg

SEQ ID NO: 492 - DNA, 735 bp, Artificial Sequence
  Synthetic Polynucleotide
atggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctaaggatgagctg

SEQ ID NO: 493 - DNA, 753 bp, Artificial Sequence
  Synthetic Polynucleotide
atggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcaaggatgagctg

SEQ ID NO: 494 - DNA, 753 bp, Artificial Sequence
  Synthetic Polynucleotide
atgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagaaggatgagctg

SEQ ID NO: 495 - DNA, 732 bp, Artificial Sequence
  Synthetic Polynucleotide
atggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcaaggatgagctg

SEQ ID NO: 496 - DNA, 747 bp, Artificial Sequence
  Synthetic Polynucleotide
atggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctaaggatgagctg

SEQ ID NO: 497 - DNA, 738 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctaaggatgagctg

SEQ ID NO: 498 - DNA, 768 bp, Artificial Sequence
  Synthetic Polynucleotide
atggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctaaggatgagctg

SEQ ID NO: 499 - DNA, 756 bp, Artificial Sequence
  Synthetic Polynucleotide
atggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctaaggatgagctg

SEQ ID NO: 500 - DNA, 834 bp, Artificial Sequence
  Synthetic Polynucleotide
atgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccaaggatgagctg

SEQ ID NO: 501 - DNA, 831 bp, Artificial Sequence
  Synthetic Polynucleotide
atgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaaaggatgagctg

SEQ ID NO: 502 - DNA, 879 bp, Artificial Sequence
  Synthetic Polynucleotide
atggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcaaggatgagctg

SEQ ID NO: 503 - DNA, 747 bp, Artificial Sequence
  Synthetic Polynucleotide
atggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctaaggatgagctg

SEQ ID NO: 504 - DNA, 744 bp, Artificial Sequence
  Synthetic Polynucleotide
atggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcaaggatgagctg

SEQ ID NO: 505 - DNA, 735 bp, Artificial Sequence
  Synthetic Polynucleotide
atggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctaaggatgagctg

SEQ ID NO: 506 - DNA, 765 bp, Artificial Sequence
  Synthetic Polynucleotide
atggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctaaggatgagctg

SEQ ID NO: 507 - DNA, 726 bp, Artificial Sequence
  Synthetic Polynucleotide
atggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctaaggatgagctg

SEQ ID NO: 508 - DNA, 750 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctaaggatgagctg

SEQ ID NO: 509 - DNA, 738 bp, Artificial Sequence
  Synthetic Polynucleotide
atggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcaaggatgagctg

SEQ ID NO: 510 - DNA, 750 bp, Artificial Sequence
  Synthetic Polynucleotide
atggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaaaggatgagctg

SEQ ID NO: 511 - DNA, 738 bp, Artificial Sequence
  Synthetic Polynucleotide
atggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtaaggatgagctg

SEQ ID NO: 512 - DNA, 762 bp, Artificial Sequence
  Synthetic Polynucleotide
atggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcaaggatgagctg

SEQ ID NO: 513 - DNA, 747 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctaaggatgagctg

SEQ ID NO: 514 - DNA, 759 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctaaggatgagctg

SEQ ID NO: 515 - DNA, 759 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctaaggatgagctg

SEQ ID NO: 516 - DNA, 741 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtaaggatgagctg

SEQ ID NO: 517 - DNA, 747 bp, Artificial Sequence
  Synthetic Polynucleotide
atgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctaaggatgagctg

SEQ ID NO: 518 - DNA, 738 bp, Artificial Sequence
  Synthetic Polynucleotide
atggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctaaggatgagctg

SEQ ID NO: 519 - DNA, 741 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctaaggatgagctg

SEQ ID NO: 520 - DNA, 729 bp, Artificial Sequence
  Synthetic Polynucleotide
atggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtaaggatgagctg

SEQ ID NO: 521 - DNA, 822 bp, Artificial Sequence
  Synthetic Polynucleotide
atgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctaaggatgagctg

SEQ ID NO: 522 - DNA, 735 bp, Artificial Sequence
  Synthetic Polynucleotide
atggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtaaggatgagctg

SEQ ID NO: 523 - DNA, 762 bp, Artificial Sequence
  Synthetic Polynucleotide
atggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctaaggatgagctg

SEQ ID NO: 524 - DNA, 774 bp, Artificial Sequence
  Synthetic Polynucleotide
atggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctaaggatgagctg

SEQ ID NO: 525 - DNA, 747 bp, Artificial Sequence
  Synthetic Polynucleotide
atggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcaaggatgagctg

SEQ ID NO: 526 - DNA, 732 bp, Artificial Sequence
  Synthetic Polynucleotide
atggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctaaggatgagctg

SEQ ID NO: 527 - DNA, 741 bp, Artificial Sequence
  Synthetic Polynucleotide
atggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcaaggatgagctg

SEQ ID NO: 528 - DNA, 726 bp, Artificial Sequence
  Synthetic Polynucleotide
atgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctaaggatgagctg

SEQ ID NO: 529 - DNA, 756 bp, Artificial Sequence
  Synthetic Polynucleotide
atggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtaaggatgagctg

SEQ ID NO: 530 - DNA, 732 bp, Artificial Sequence
  Synthetic Polynucleotide
atggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctaaggatgagctg

SEQ ID NO: 531 - DNA, 741 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctaaggatgagctg

SEQ ID NO: 532 - DNA, 771 bp, Artificial Sequence
  Synthetic Polynucleotide
atggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtaaggatgagctg

SEQ ID NO: 533 - DNA, 762 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctaaggatgagctg

SEQ ID NO: 534 - DNA, 738 bp, Artificial Sequence
  Synthetic Polynucleotide
atggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctaaggatgagctg

SEQ ID NO: 535 - DNA, 717 bp, Artificial Sequence
  Synthetic Polynucleotide
atgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctaaggatgagctg

SEQ ID NO: 536 - DNA, 732 bp, Artificial Sequence
  Synthetic Polynucleotide
atgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctaaggatgagctg

SEQ ID NO: 537 - DNA, 741 bp, Artificial Sequence
  Synthetic Polynucleotide
atggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctaaggatgagctg

SEQ ID NO: 538 - DNA, 756 bp, Artificial Sequence
  Synthetic Polynucleotide
atggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctaaggatgagctg

SEQ ID NO: 539 - DNA, 741 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtaaggatgagctg

SEQ ID NO: 540 - DNA, 759 bp, Artificial Sequence
  Synthetic Polynucleotide
atggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctaaggatgagctg

SEQ ID NO: 541 - DNA, 753 bp, Artificial Sequence
  Synthetic Polynucleotide
atggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctaaggatgagctg

SEQ ID NO: 542 - DNA, 753 bp, Artificial Sequence
  Synthetic Polynucleotide
atggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctaaggatgagctg

SEQ ID NO: 543 - DNA, 747 bp, Artificial Sequence
  Synthetic Polynucleotide
atggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaaaggatgagctg

SEQ ID NO: 544 - DNA, 738 bp, Artificial Sequence
  Synthetic Polynucleotide
atggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctaaggatgagctg

SEQ ID NO: 545 - DNA, 741 bp, Artificial Sequence
  Synthetic Polynucleotide
atggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcaaggatgagctg

SEQ ID NO: 546 - DNA, 747 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctaaggatgagctg

SEQ ID NO: 547 - DNA, 750 bp, Artificial Sequence
  Synthetic Polynucleotide
atggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctaaggatgagctg

SEQ ID NO: 548 - DNA, 750 bp, Artificial Sequence
  Synthetic Polynucleotide
atggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctaaggatgagctg

SEQ ID NO: 549 - DNA, 750 bp, Artificial Sequence
  Synthetic Polynucleotide
atggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctaaggatgagctg

SEQ ID NO: 550 - DNA, 744 bp, Artificial Sequence
  Synthetic Polynucleotide
atggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctaaggatgagctg

SEQ ID NO: 551 - DNA, 744 bp, Artificial Sequence
  Synthetic Polynucleotide
atggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctaaggatgagctg

SEQ ID NO: 552 - DNA, 759 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcaaggatgagctg

SEQ ID NO: 553 - DNA, 759 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcaaggatgagctg

SEQ ID NO: 554 - DNA, 753 bp, Artificial Sequence
  Synthetic Polynucleotide
atggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtaaggatgagctg

SEQ ID NO: 555 - DNA, 738 bp, Artificial Sequence
  Synthetic Polynucleotide
atggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctaaggatgagctg

SEQ ID NO: 556 - DNA, 723 bp, Artificial Sequence
  Synthetic Polynucleotide
atggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctaaggatgagctg

SEQ ID NO: 557 - DNA, 741 bp, Artificial Sequence
  Synthetic Polynucleotide
atggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagaaggatgagctg

SEQ ID NO: 558 - DNA, 762 bp, Artificial Sequence
  Synthetic Polynucleotide
atggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtaaggatgagctg

SEQ ID NO: 559 - DNA, 765 bp, Artificial Sequence
  Synthetic Polynucleotide
atggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctaaggatgagctg

SEQ ID NO: 560 - DNA, 756 bp, Artificial Sequence
  Synthetic Polynucleotide
atggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtaaggatgagctg

SEQ ID NO: 561 - DNA, 747 bp, Artificial Sequence
  Synthetic Polynucleotide
atggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctaaggatgagctg

SEQ ID NO: 562 - DNA, 780 bp, Artificial Sequence
  Synthetic Polynucleotide
atggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaaaggatgagctg

SEQ ID NO: 563 - DNA, 768 bp, Artificial Sequence
  Synthetic Polynucleotide
atgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaaaggatgagctg

SEQ ID NO: 564 - DNA, 750 bp, Artificial Sequence
  Synthetic Polynucleotide
atggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtaaggatgagctg

SEQ ID NO: 565 - DNA, 741 bp, Artificial Sequence
  Synthetic Polynucleotide
atggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtaaggatgagctg

SEQ ID NO: 566 - DNA, 735 bp, Artificial Sequence
  Synthetic Polynucleotide
atggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctaaggatgagctg

SEQ ID NO: 567 - DNA, 741 bp, Artificial Sequence
  Synthetic Polynucleotide
atggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctaaggatgagctg

SEQ ID NO: 568 - DNA, 747 bp, Artificial Sequence
  Synthetic Polynucleotide
atgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctaaggatgagctg

SEQ ID NO: 569 - DNA, 762 bp, Artificial Sequence
  Synthetic Polynucleotide
atgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcaaggatgagctg

SEQ ID NO: 570 - DNA, 744 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctaaggatgagctg

SEQ ID NO: 571 - DNA, 747 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcaaggatgagctg

SEQ ID NO: 572 - DNA, 744 bp, Artificial Sequence
  Synthetic Polynucleotide
atgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctaaggatgagctg

SEQ ID NO: 573 - DNA, 741 bp, Artificial Sequence
  Synthetic Polynucleotide
atgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgaaggatgagctg

SEQ ID NO: 574 - DNA, 741 bp, Artificial Sequence
  Synthetic Polynucleotide
atgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctaaggatgagctg

SEQ ID NO: 575 - DNA, 747 bp, Artificial Sequence
  Synthetic Polynucleotide
atgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctaaggatgagctg

SEQ ID NO: 576 - DNA, 741 bp, Artificial Sequence
  Synthetic Polynucleotide
atggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctaaggatgagctg

SEQ ID NO: 577 - DNA, 738 bp, Artificial Sequence
  Synthetic Polynucleotide
atggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtaaggatgagctg

SEQ ID NO: 578 - DNA, 738 bp, Artificial Sequence
  Synthetic Polynucleotide
atggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctaaggatgagctg

SEQ ID NO: 579 - DNA, 762 bp, Artificial Sequence
  Synthetic Polynucleotide
atggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccaaggatgagctg

SEQ ID NO: 580 - DNA, 780 bp, Artificial Sequence
  Synthetic Polynucleotide
atgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcaaggatgagctg

SEQ ID NO: 581 - DNA, 735 bp, Artificial Sequence
  Synthetic Polynucleotide
atggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcaaggatgagctg

SEQ ID NO: 582 - DNA, 765 bp, Artificial Sequence
  Synthetic Polynucleotide
atggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaaaggatgagctg

SEQ ID NO: 583 - DNA, 753 bp, Artificial Sequence
  Synthetic Polynucleotide
atggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctaaggatgagctg

SEQ ID NO: 584 - DNA, 705 bp, Artificial Sequence
  Synthetic Polynucleotide
atggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcaaggatgagctg

SEQ ID NO: 585 - DNA, 735 bp, Artificial Sequence
  Synthetic Polynucleotide
atggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctaaggatgagctg

SEQ ID NO: 586 - DNA, 747 bp, Artificial Sequence
  Synthetic Polynucleotide
atggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctaaggatgagctg

SEQ ID NO: 587 - DNA, 735 bp, Artificial Sequence
  Synthetic Polynucleotide
atggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctaaggatgagctg

SEQ ID NO: 588 - DNA, 738 bp, Artificial Sequence
  Synthetic Polynucleotide
atggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctaaggatgagctg

SEQ ID NO: 589 - DNA, 753 bp, Artificial Sequence
  Synthetic Polynucleotide
atggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtaaggatgagctg

SEQ ID NO: 590 - DNA, 735 bp, Artificial Sequence
  Synthetic Polynucleotide
atggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctaaggatgagctg

SEQ ID NO: 591 - DNA, 738 bp, Artificial Sequence
  Synthetic Polynucleotide
atggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccaaggatgagctg

SEQ ID NO: 592 - DNA, 762 bp, Artificial Sequence
  Synthetic Polynucleotide
atggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaaaggatgagctg

SEQ ID NO: 593 - DNA, 750 bp, Artificial Sequence; identical to SEQ ID NO: 510
  Synthetic Polynucleotide

SEQ ID NO: 594 - DNA, 741 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctaaggatgagctg

SEQ ID NO: 595 - DNA, 741 bp, Artificial Sequence
  Synthetic Polynucleotide
atggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctaaggatgagctg

SEQ ID NO: 596 - DNA, 738 bp, Artificial Sequence
  Synthetic Polynucleotide
atggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcaaggatgagctg

SEQ ID NO: 597 - DNA, 735 bp, Artificial Sequence
  Synthetic Polynucleotide
atggatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacaaggatgagctg

SEQ ID NO: 598 - DNA, 738 bp, Artificial Sequence
  Synthetic Polynucleotide
atggacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctaaggatgagctg

SEQ ID NO: 599 - DNA, 750 bp, Artificial Sequence
  Synthetic Polynucleotide
atggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctaaggatgagctg

SEQ ID NO: 600 - DNA, 759 bp, Artificial Sequence
  Synthetic Polynucleotide
atggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcaaggatgagctg

SEQ ID NO: 601 - DNA, 765 bp, Artificial Sequence
  Synthetic Polynucleotide
atggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtaaggatgagctg

SEQ ID NO: 602 - DNA, 762 bp, Artificial Sequence
  Synthetic Polynucleotide
atggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtaaggatgagctg

SEQ ID NO: 603 - DNA, 732 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcaaggatgagctg

SEQ ID NO: 604 - DNA, 738 bp, Artificial Sequence
  Synthetic Polynucleotide
atggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctaaggatgagctg

SEQ ID NO: 605 - DNA, 738 bp, Artificial Sequence
  Synthetic Polynucleotide
atggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctaaggatgagctg

SEQ ID NO: 606 - DNA, 741 bp, Artificial Sequence
  Synthetic Polynucleotide
atggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtaaggatgagctg

SEQ ID NO: 607 - DNA, 735 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctaaggatgagctg

SEQ ID NO: 608 - DNA, 792 bp, Artificial Sequence
  Synthetic Polynucleotide
atggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtaaggatgagctg

SEQ ID NO: 609 - DNA, 783 bp, Artificial Sequence
  Synthetic Polynucleotide
atggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctaaggatgagctg

SEQ ID NO: 610 - DNA, 705 bp, Artificial Sequence
  Synthetic Polynucleotide
atggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctaaggatgagctg

SEQ ID NO: 611 - DNA, 753 bp, Artificial Sequence
  Synthetic Polynucleotide
atggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctaaggatgagctg

SEQ ID NO: 612 - DNA, 726 bp, Artificial Sequence
  Synthetic Polynucleotide
atggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtaaggatgagctg

SEQ ID NO: 613 - DNA, 729 bp, Artificial Sequence
  Synthetic Polynucleotide
atggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctaaggatgagctg

SEQ ID NO: 614 - DNA, 729 bp, Artificial Sequence
  Synthetic Polynucleotide
atggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctaaggatgagctg

SEQ ID NO: 615 - DNA, 762 bp, Artificial Sequence
  Synthetic Polynucleotide
atggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtaaggatgagctg

SEQ ID NO: 616 - DNA, 750 bp, Artificial Sequence
  Synthetic Polynucleotide
atgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtaaggatgagctg

SEQ ID NO: 617 - DNA, 735 bp, Artificial Sequence
  Synthetic Polynucleotide
atggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctaaggatgagctg

SEQ ID NO: 618 - DNA, 747 bp, Artificial Sequence
  Synthetic Polynucleotide
atggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctaaggatgagctg

SEQ ID NO: 619 - DNA, 774 bp, Artificial Sequence
  Synthetic Polynucleotide
atggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctaaggatgagctg

SEQ ID NO: 620 - DNA, 747 bp, Artificial Sequence
  Synthetic Polynucleotide
atggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctaaggatgagctg

SEQ ID NO: 621 - DNA, 756 bp, Artificial Sequence
  Synthetic Polynucleotide
atggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctaaggatgagctg

SEQ ID NO: 622 - DNA, 741 bp, Artificial Sequence
  Synthetic Polynucleotide
atggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctaaggatgagctg

SEQ ID NO: 623 - DNA, 744 bp, Artificial Sequence
  Synthetic Polynucleotide
atggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctaaggatgagctg

SEQ ID NO: 624 - DNA, 735 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctaaggatgagctg

SEQ ID NO: 625 - DNA, 771 bp, Artificial Sequence
  Synthetic Polynucleotide
atggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctaaggatgagctg

SEQ ID NO: 626 - DNA, 741 bp, Artificial Sequence
  Synthetic Polynucleotide
atggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctaaggatgagctg

SEQ ID NO: 627 - DNA, 732 bp, Artificial Sequence
  Synthetic Polynucleotide
atggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtaaggatgagctg

SEQ ID NO: 628 - DNA, 747 bp, Artificial Sequence
  Synthetic Polynucleotide
atggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcaaggatgagctg

SEQ ID NO: 629 - DNA, 744 bp, Artificial Sequence
  Synthetic Polynucleotide
atggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctaaggatgagctg

SEQ ID NO: 630 - DNA, 750 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctaaggatgagctg

SEQ ID NO: 631 - DNA, 738 bp, Artificial Sequence
  Synthetic Polynucleotide
atgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctaaggatgagctg

SEQ ID NO: 632 - DNA, 732 bp, Artificial Sequence
  Synthetic Polynucleotide
atggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctaaggatgagctg

SEQ ID NO: 633 - DNA, 765 bp, Artificial Sequence
  Synthetic Polynucleotide
atggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtaaggatgagctg

SEQ ID NO: 634 - DNA, 750 bp, Artificial Sequence
  Synthetic Polynucleotide
atggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcaaggatgagctg

SEQ ID NO: 635 - DNA, 753 bp, Artificial Sequence
  Synthetic Polynucleotide
atggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtaaggatgagctg

SEQ ID NO: 636 - DNA, 753 bp, Artificial Sequence
  Synthetic Polynucleotide
atggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctaaggatgagctg

SEQ ID NO: 637 - DNA, 753 bp, Artificial Sequence
  Synthetic Polynucleotide
atgcaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcaaggatgagctg

SEQ ID NO: 638 - DNA, 735 bp, Artificial Sequence
  Synthetic Polynucleotide
atggacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtaaggatgagctg

SEQ ID NO: 639 - DNA, 741 bp, Artificial Sequence
  Synthetic Polynucleotide
atggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtaaggatgagctg

SEQ ID NO: 640 - DNA, 738 bp, Artificial Sequence
  Synthetic Polynucleotide
atggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctaaggatgagctg

SEQ ID NO: 641 - DNA, 744 bp, Artificial Sequence
  Synthetic Polynucleotide
atggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctaaggatgagctg

SEQ ID NO: 642 - DNA, 717 bp, Artificial Sequence
  Synthetic Polynucleotide
atggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctaaggatgagctg

SEQ ID NO: 643 - DNA, 726 bp, Artificial Sequence
  Synthetic Polynucleotide
atggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctaaggatgagctg

SEQ ID NO: 644 - DNA, 747 bp, Artificial Sequence
  Synthetic Polynucleotide
atggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctaaggatgagctg

SEQ ID NO: 645 - DNA, 735 bp, Artificial Sequence
  Synthetic Polynucleotide
atggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctaaggatgagctg

SEQ ID NO: 646 - DNA, 738 bp, Artificial Sequence
  Synthetic Polynucleotide
atggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctaaggatgagctg

SEQ ID NO: 647 - DNA, 741 bp, Artificial Sequence
  Synthetic Polynucleotide
atggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctaaggatgagctg

SEQ ID NO: 648 - DNA, 756 bp, Artificial Sequence
  Synthetic Polynucleotide
atggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtaaggatgagctg

SEQ ID NO: 649 - DNA, 780 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctaaggatgagctggagcagaaactgatctcggaagaggatctgtga

SEQ ID NO: 650 - DNA, 762 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacgccgcctaccctacttttggcggagggaccaaggttgagatcaaacggggcggaggcggaagtggaggcggaggatctggcggcggaggctctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggcggtgtactactgcgccagagagagttggccaatggacgtatggggccagggaacaactgtcaccgtctcctcaaaggatgagctggagcagaaactgatctcggaagaggatctgtga

SEQ ID NO: 651 - DNA, 777 bp, Artificial Sequence
  Synthetic Polynucleotide
atggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaaaggcggaggcggaagtggaggcggaggatctggcggcggaggctctcaaatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctaaggatgagctggagcagaaactgatctcggaagaggatctgtga

SEQ ID NO: 652 - DNA, 768 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagaatctcctggcctttcacttttggcggagggaccaaggttgagatcaaaggcggaggcggaagtggaggcggaggatctggcggcggaggctctgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggcggtgtactactgcgcaagagccgagatgggagccgtattcgacatatggggtcagggtacaatggtcaccgtctcctcaaaggatgagctggagcagaaactgatctcggaagaggatctgtga

SEQ ID NO: 653 - DNA, 783 bp, Artificial Sequence
  Synthetic Polynucleotide
atggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagacacgtctggcctcctacttttggcggagggaccaaggttgagatcaaacggggcggaggcggaagtggaggcggaggatctggcggcggaggctctcagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagaggcaggggatatgcaaccagcttagccttcgatatctggggtcagggtacaatggtcaccgtctcctcaaaggatgagctggagcagaaactgatctcggaagaggatctgtga

SEQ ID NO: 654 - DNA, 798 bp, Artificial Sequence
  Synthetic Polynucleotide
atggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagggactcggcctccctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgccagagacggtacttatctaggtggtctctggtacttcgacttatgggggagaggtaccttggtcaccgtctcctcaaaggatgagctggagcagaaactgatctcggaagaggatctgtga

SEQ ID NO: 655 - DNA, 813 bp, Artificial Sequence
  Synthetic Polynucleotide
atggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgcccacactcctttcacttttggcggagggaccaaggttgagatcaaacggggcggaggcggaagtggaggcggaggatctggcggcggaggctctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagaactcctgaatactcctccagcatatggcactattactacggcatggacgtatggggccagggaacaactgtcaccgtctcctcaaaggatgagctggagcagaaactgatctcggaagaggatctgtga

SEQ ID NO: 656 - DNA, 786 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatagcgcatccaccagggccactggtatcccagccaggttcagtggcagtgggtctgggacagagttcactctcaccatcagcagcctgcagtctgaagattttgcagtttattactgtcagcagcaccacgtctggcctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgtcaaggggccgttgcaggagccgccatacgattatggaatggacgtatggggccagggaacaactgtcaccgtctcctcaaaggatgagctggagcagaaactgatctcggaagaggatctgtga

SEQ ID NO: 657 - DNA, 774 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattctactacccttggacttttggcggagggaccaaggttgagatcaaacggggcggaggcggaagtggaggcggaggatctggcggcggaggctctgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcaaccattagtagtagtagtagtaccatatactacgcagactctgtgaagggccgattcaccatctccagagacaatgccaagaactcactgtatctgcaaatgaacagcctgagagctgaggacacggcggtgtactactgcgccagaggttctcaggagcacctgattttcgattattggggacagggtacattggtcaccgtctcctcaaaggatgagctggagcagaaactgatctcggaagaggatctgtga

SEQ ID NO: 658 - DNA, 789 bp, Artificial Sequence
  Synthetic Polynucleotide
atggacatccagatgacacagagccctagcagcctgtctgccagcgtgggagacagagtgaccatcacctgtaccgccagcagcagagtgtccagcagctacctgcactggttccagcagaagcctggcaaggcccctaagctgctgatctacagcaccagcaatctggcctctggcgtgcccagcagattttctggctctggcagcggcaccgacttcaccctgacaatatctagcctccagcctgaggacttcgccacctactactgccaccagtaccacagaagcccctacacattcggccagggcaccaaggtggaaatcaagagaggcggaggcggaagtggaggcggaggatctggcggcggaggctctgaagttcagctggttgaatctggcggcggactggttcaacctggcggatctctgagactgagctgtgccgcctctggctacgccttcagcaacagctggatcaactgggtccgacaggcccctggcaaaggactggaatgggtcggacaaatctaccccggcgactacgacaccaactacaacggcaagttcaagggcagattcaccatcagccgggacaagagcaagaacaccgcctacctccagatgaactccctgagagccgaggacaccgccgtgtactattgtgctagaggcggctccatctactacggcaacctgggcttcttcgacgtgtggggacagggcacactggtcacagtctcttctaaggatgagctggagcagaaactgatctcggaagaggatctgtga

SEQ ID NO: 659 - DNA, 759 bp, Artificial Sequence
  Synthetic Polynucleotide
atggacatccagatgacacagagccctagcagcctgtctgccagcgtgggagacagagtgaccatcacatgtagcgccagcagcagcgtgacctacatgtactggtatcagcagaagcccggcaaggcccctaagctgctgatctacgacaccagcaatctggcctctggcgtgcccagcagattttctggctctggcagcggcaccgactacaccctgacaatatctagcctccagcctgaggacttcgccacctactactgccagcagtggtccaactatcccctgacattcggccagggcaccaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacagcttcatcgagtacaccatcaactgggtccgacaggcccctggacaaggcctggaatggatcggcaacatcgacccctactacggcacaacctactacaaccagatgttcaccggcagagccacactgaccgtggacacctctatcagcaccgcctacatggaactgagccggctgagatccgatgacaccgccgtgtactattgtgccagaggcagcgcctggtttccctattggggacagggaaccctggtcaccgttagctctaaggatgagctggagcagaaactgatctcggaagaggatctgtga

SEQ ID NO: 660 - DNA, 759 bp, Artificial Sequence
  Synthetic Polynucleotide
atggagatcgtgctgacacagagcccttctagcctgtctgccagcgtgggcgacagagtgaccatcacatgtagagccagcgagaacatctacagctacctggcctggtatcagcagaagcctggcaaggcccctaagctgctgatctacaacaccaagacactcggcgagggcgtgcccagcagattttctggttctggcagcggcaccgacttcaccctgaccatatctagcctgcagcctgaggacttcgccacctactactgccagcaccactacggcacccctttcacatttggccctggcaccaaggtggacatcaaaggcggaggcggaagtggaggcggaggatctggcggcggaggctctcaagttcagctggttcagagcggagccgaagtgaagaaacctggggcctctgtgaaggtgtcctgcaaggccagcggctacaccttcagcgactattgggtgcactgggtccgacaggctccaggacaaggactggaatggatgggagccatcgacggcagcgataccttcaacgattacagccagaaattcaaaggccgcgtgaccatgaccagagacaccagcatcagcaccgcctacatggaactgagccggctgagatccgatgacaccgccgtgtactattgtgccagaggcggcctgctgcagtattggggacagggaacactggtcaccgtgtcctctaaggatgagctggagcagaaactgatctcggaagaggatctgtga

SEQ ID NO: 661 - DNA, 771 bp, Artificial Sequence
  Synthetic Polynucleotide
atggagatcgtgctgacacagtctcccgccacactgtcactgtctccaggcgaaagagccacactgagctgtagcgccagcagcagcgtgtcctacatgcactggtatcagcagaagcccggacaggcccctagactgctgatctacgataccagcaagctggcctctgacatccccgccagattttctggcagcggctctggcaccgatttcaccctgaccataagcagcctggaacctgaggacttcgccgtgtactactgtcagcagggcagcgtgtaccccttcacatttggcggcggaacaaaggtggaaatcaaaggcggaggcggaagtggaggcggaggatctggcggcggaggctctcaagttcagctgcaagagtctggccctggcctggttaagcctagcggaacactgagcctgacctgtgctgtgtctggcggcagcatcagcacatctggcatgggcgttggctgggtccgacagcctcctggaaaaggcctggaatggatcggccacatttggtgggacgacgacaagcggtacaaccccgctctgaagtccagagtgaccatcagcgtggacaagagcaagaaccagttcagcctgcggctgagcagcgtgacagctgcagataccgccgtgtattattgcgcccggatggaactgtggtcctactacttcgactactggggcaagggcaccaccgtgactgtctcttctaaggatgagctggagcagaaactgatctcggaagaggatctgtga

SEQ ID NO: 662 - DNA, 783 bp, Artificial Sequence
  Synthetic Polynucleotide
atggacatccagatgacccagaccacaagcagcctgtctgccagcctgggcgacagagtgaccatctcttgtagagccagccaggacatcagcaactacctgaactggtatcagcagaaacccgacggcaccgtgaagctgctgatctactacaccagcatcctgcacagcggcgtgcccagcagattttctggctctggcagcggcaccgactacagcctgaccatcagcaatctggaacaagaggacttcgctacctacttctgccagcaaggcaacaccctgccttggacatttggcggaggcaccaagctggaaatcaaagctggcggaggcggaagtggaggcggaggatctggcggcggaggctctgaagtgcaactggttgaatctggcggcggactggttaagcctggcggatctctgaagctgagctgtgccgcctctggcttcgccttcagcatctacgatatgagctgggtccgacagacccctgagaagagactggaatgggtcgcctacatctctagcggcggagggacctactatcccgacacagtgaagggcagattcaccatctccagagacaacgccaagaacaccctgtacctccagatgagcagcctgaagtccgaggacaccgccatgtactactgcgccagacacagcggctatggcacacattggggagtgctgtttgcctactggggccagggaacactggtcacagtttctgctaaggatgagctggagcagaaactgatctcggaagaggatctgtga

SEQ ID NO: 663 - DNA, 783 bp, Artificial Sequence
  Synthetic Polynucleotide
atggatattcaactgacacaatcccccagctcactcagcgccagcgtgggggacagggttagctttacctgtcaagcctctcaggatataaataactttctgaactggtatcaacagaagcctgggaaggcgcccaaactcctgatctatgatgcgtccaacctggaaactggcgtgccttcacgctttagcggctctggcagtggtacagacttcacttttaccatctcttcacttcagccggaggacatcgccacatattactgtcaacagtacggaaacttgccctttacttttggaggcggcaccaaagttgaaatcaaaagaggcggaggcggaagtggaggcggaggatctggcggcggaggctctcaggtccaactgcaagaaagcggacccggactggtgaagccttctgagacacttagtctgacgtgcacggtcagtggcggctccatctcctcctattattggtcatggatacgacaacccccaggtaagggcctggaatggattggctatatctactattcaggaagcacgaactacaatcccagcctgaagtcccgagtgacaatttcagtagataccagtaaaaaccagttcagtcttaaactgtcaagcgtgacagctgccgacaccgctgtgtattactgcgtctcactggtgtattgtggaggggattgttatagcgggttcgattattggggacagggaaccctggtgactgtatcttccaaggatgagctggagcagaaactgatctcggaagaggatctgtga

SEQ ID NO: 664 - DNA, 789 bp, Artificial Sequence
  Synthetic Polynucleotide
atggatatccagctcactcaaagcccctctagtctctctgcctcagtgggggatcgggtcagttttacttgtcaagcttcacaggatatcaacaacttccttaattggtatcagcagaagccaggaaaagcacccaagctgctcatctatgatgcctcaaatttggagacgggtgttcccagtcgattctctgggtcagggtccgggaccgactttacgtttacgatctcctctctgcagcccgaagacatcgccacatactattgtcaacagtacggcaacttgcctttcacatttgggggcgggactaaggttgaaatcaagaggggcggaggcggaagtggaggcggaggatctggcggcggaggctctcaggtacagctgcaggaatctgggcccggacttgtcaagccaagtcagacactttctcttacatgtaccgtgagcggcggaagtataagcagtggaggcttttactggtcttggatacggcagcacccaggcaaaggcttggagtggattggatacattcatcattcaggatctacacactataatccatcccttaagtcccgggtcaccattagcattgatacgtctaagaatctgttcagtctcaggctgtcctccgtcactgctgccgacacagccgtgtactactgcgcctccttggtttactgcggaggcgactgttatagcggctttgattattgggggcaggggaccctcgtaaccgtgagctctaaggatgagctggagcagaaactgatctcggaagaggatctgtga

SEQ ID NO: 665 - DNA, 789 bp, Artificial Sequence
  Synthetic Polynucleotide
atggacttcgtgatgacacagagccctctgagcctgcctgtgacacctggcgaacctgccagcatcagctgtagaagcagccagagcatcgtgcacagcaacggcaacacctacctggaatggtatctccagaagcctggacagagcccacagctgctgatctacaaggtgtccaacagattcagcggcgtgcccgacagattttctggcagcggctctggcaccgacttcaccctgaagattagcagagtggaagccgaggacgtgggcgtgtactactgcttccaaggctctcacgtgcccctgacctttggacagggcaccaagctggaaatcaagagaggcggaggcggaagtggaggcggaggatctggcggcggaggctctgaagtgcagctggttgaaagcggagccgaagtgaagaaacctggggcctctgtgaaggtgtcctgcaaggccagcggctacacctttaccagctactggattcactgggtccgacaggcccctggacaaggacttgagtggatgggcgagaacgacccctccaacggcaggaccaactacaacgagaagttcaagaaccgcgtgaccctgaccgtggacaccagcatctctaccgcctacatggaactgagccggctgagatccgatgacaccgccgtgtactattgcgccagaggacccaactacttttacagcatggactactggggccagggcacaatggtcaccgttagctctaaggatgagctggagcagaaactgatctcggaagaggatctgtga

SEQ ID NO: 666 - DNA, 780 bp, Artificial Sequence
  Synthetic Polynucleotide
atggagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggcggaggcggaagtggaggcggaggatctggcggcggaggctctcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcaaggatgagctggagcagaaactgatctcggaagaggatctgtga

SEQ ID NO: 667 - DNA, 780 bp, Artificial Sequence
  Synthetic Polynucleotide
atgcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggcggaggcggaagtggaggcggaggatctggcggcggaggctctgagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcaaggatgagctggagcagaaactgatctcggaagaggatctgtga

SEQ ID NO: 668 - DNA, 798 bp, Artificial Sequence
  Synthetic Polynucleotide
atggacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggcggaggcggaagtggaggcggaggatctggcggcggaggctctcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcaaggatgagctggagcagaaactgatctcggaagaggatctgtga

SEQ ID NO: 669 - DNA, 798 bp, Artificial Sequence
  Synthetic Polynucleotide
atgcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggcggaggcggaagtggaggcggaggatctggcggcggaggctctgacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggaaggatgagctggagcagaaactgatctcggaagaggatctgtga

SEQ ID NO: 670 - DNA, 768 bp, Artificial Sequence
  Synthetic Polynucleotide
atggacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggcggaggcggaagtggaggcggaggatctggcggcggaggctctcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctaaggatgagctggagcagaaactgatctcggaagaggatctgtga

SEQ ID NO: 671 - DNA, 768 bp, Artificial Sequence
  Synthetic Polynucleotide
atgcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggcggaggcggaagtggaggcggaggatctggcggcggaggctctgacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaaaggatgagctggagcagaaactgatctcggaagaggatctgtga

SEQ ID NO: 672 - DNA, 745 bp, Artificial Sequence
  Synthetic Polynucleotide
atggagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtaaggatgagctggagcagaaactgatctcggaagaggatctgtga

SEQ ID NO: 673 - DNA, 745 bp, Artificial Sequence; identical to SEQ ID NO: 672
  Synthetic Polynucleotide

SEQ ID NO: 674 - DNA, 757 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtaaggatgagctggagcagaaactgatctcggaagaggatctgtga

SEQ ID NO: 675 - DNA, 757 bp, Artificial Sequence; identical to SEQ ID NO: 674
  Synthetic Polynucleotide

SEQ ID NO: 676 - DNA, 783 bp, Artificial Sequence
  Synthetic Polynucleotide
atggacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggcggaggcggaagtggaggcggaggatctggcggcggaggctctcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctaaggatgagctggagcagaaactgatctcggaagaggatctgtga

SEQ ID NO: 677 - DNA, 783 bp, Artificial Sequence
  Synthetic Polynucleotide
atgcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggcggaggcggaagtggaggcggaggatctggcggcggaggctctgacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaaaggatgagctggagcagaaactgatctcggaagaggatctgtga

SEQ ID NO: 678 - DNA, 792 bp, Artificial Sequence
  Synthetic Polynucleotide
atgcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggcggaggcggaagtggaggcggaggatctggcggcggaggctctcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtaaggatgagctggagcagaaactgatctcggaagaggatctgtga

SEQ ID NO: 679 - DNA, 792 bp, Artificial Sequence
  Synthetic Polynucleotide
atgcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggcggaggcggaagtggaggcggaggatctggcggcggaggctctcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaaaggatgagctggagcagaaactgatctcggaagaggatctgtga

SEQ ID NO: 680 - DNA, 768 bp, Artificial Sequence
  Synthetic Polynucleotide
atggacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggcggaggcggaagtggaggcggaggatctggcggcggaggctctcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctaaggatgagctggagcagaaactgatctcggaagaggatctgtga

SEQ ID NO: 681 - DNA, 768 bp, Artificial Sequence
  Synthetic Polynucleotide
atgcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggcggaggcggaagtggaggcggaggatctggcggcggaggctctgacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaaaggatgagctggagcagaaactgatctcggaagaggatctgtga

SEQ ID NO: 682 - DNA, 792 bp, Artificial Sequence
  Synthetic Polynucleotide
atggacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggcggaggcggaagtggaggcggaggatctggcggcggaggctctcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctaaggatgagctggagcagaaactgatctcggaagaggatctgtga

SEQ ID NO: 683 - DNA, 792 bp, Artificial Sequence
  Synthetic Polynucleotide
atgcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggcggaggcggaagtggaggcggaggatctggcggcggaggctctgacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaaaggatgagctggagcagaaactgatctcggaagaggatctgtga

SEQ ID NO: 684 - DNA, 777 bp, Artificial Sequence
  Synthetic Polynucleotide
atggacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggcggaggcggaagtggaggcggaggatctggcggcggaggctctgaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctaaggatgagctggagcagaaactgatctcggaagaggatctgtga

SEQ ID NO: 685 - DNA, 777 bp, Artificial Sequence
  Synthetic Polynucleotide
atggaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggcggaggcggaagtggaggcggaggatctggcggcggaggctctgacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggaaggatgagctggagcagaaactgatctcggaagaggatctgtga

SEQ ID NO: 686 - DNA, 768 bp, Artificial Sequence
  Synthetic Polynucleotide
atggacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctaaggatgagctggagcagaaactgatctcggaagaggatctgtga

SEQ ID NO: 687 - DNA, 768 bp, Artificial Sequence
  Synthetic Polynucleotide
atggaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggcggaggcggaagtggaggcggaggatctggcggcggaggctctgacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaaaggatgagctggagcagaaactgatctcggaagaggatctgtga

SEQ ID NO: 688 - DNA, 768 bp, Artificial Sequence
  Synthetic Polynucleotide
atggacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggcggaggcggaagtggaggcggaggatctggcggcggaggctctgaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctaaggatgagctggagcagaaactgatctcggaagaggatctgtga

SEQ ID NO: 689 - DNA, 768 bp, Artificial Sequence
  Synthetic Polynucleotide
atggaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggcggaggcggaagtggaggcggaggatctggcggcggaggctctgacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttaaggatgagctggagcagaaactgatctcggaagaggatctgtga

SEQ ID NO: 690 - DNA, 792 bp, Artificial Sequence
  Synthetic Polynucleotide
atgcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggcggaggcggaagtggaggcggaggatctggcggcggaggctctcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctaaggatgagctggagcagaaactgatctcggaagaggatctgtga

SEQ ID NO: 691 - DNA, 792 bp, Artificial Sequence
  Synthetic Polynucleotide
atgcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggcggaggcggaagtggaggcggaggatctggcggcggaggctctcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcaaggatgagctggagcagaaactgatctcggaagaggatctgtga

SEQ ID NO: 692 - DNA, 813 bp, Artificial Sequence
  Synthetic Polynucleotide
atggacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggcggaggcggaagtggaggcggaggatctggcggcggaggctctgaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctaaggatgagctggagcagaaactgatctcggaagaggatctgtga

SEQ ID NO: 693 - DNA, 813 bp, Artificial Sequence
  Synthetic Polynucleotide
atggaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggcggaggcggaagtggaggcggaggatctggcggcggaggctctgacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttaaggatgagctggagcagaaactgatctcggaagaggatctgtga

SEQ ID NO: 694 - DNA, 729 bp, Artificial Sequence
  Synthetic Polynucleotide
atggtcgtgatgacccagacccctctgagcctgagcgtgacactgggacagcctgccagcatcagctgcaagagcagccagagcctgctgcacagcgacggcaagacctacctgaactggctgcagcagaggccaggccagagccctcggagactgatctacctggtgtccaagctggacagcggcgtgcccgatagattttccggctctggcagcggcaccgacttcaccctgaagatcagccgggtggaagccgaggacgtgggcatctactactgttggcagggcacccacctgtggacctttggcggcggaacaaaggtggaaatcaagggcggaggcggaagtggaggcggaggatctggcggcggaggctctgaagtgcacctggtggaaagcggcggaggactggtgcagccagggggatctctgagactgtcttgtgccgccagcggcttcaccttcagcagatacggcatgagctgggtgcgccaggcccctggaaaaggactggaactggtggctatgatgaagaccaagggcggcagaacctactaccccgacagcgtgaagggccggttcaccatctcccgggacaacgccaagaacagcctgtacctgcagatgaactccctgcgggccgaggacaccgccatctactattgtgcctccgacggctactactggggccagggaacaaccgtcaccgtgtcctctaaggatgagctg

SEQ ID NO: 695 - DNA, 738 bp, Artificial Sequence
  Synthetic Polynucleotide
atggagatcgtgctgacacagtctcccgccacactgtcactgtctccaggcgaaagagccacactgagctgtagcgccaccagcagcgtgtcctacatgcactggtatcagcagaagcccggcaaggcccctaagcggtggatctacgataccagcaaactggcctctggcgtgcccagcagattttctggctctggcagcggcaccgagttcaccctgacaatatctagcctccagcctgaggacttcgccacctactactgccagcagtggtccagcaatcccctgacctttggacagggcaccaagctggaaatcaaaggcggaggcggaagtggaggcggaggatctggcggcggaggctctcaagttcagctggttcagtctggggccgaagtgaagaaacctggggcctctgtgaaggtgtcctgcaaggccagcggctacaagttcaccagctacgtgatgcactgggtccgacaggctccaggacaaggactggaatggatcggctacatcaacccctacaacgacgtgaccaagtacaacgagaagttcaagggcagagtgaccatcaccgccgacaagagcacaagcaccgcctacatggaactgagcagcctgagaagcgaggacaccgccgtgcactattgtgccagaggcagctactacgactacgacggctttgtgtattggggccagggcaccctggtcaccgtttcttctaaggatgagctg

SEQ ID NO: 696 - DNA, 753 bp, Artificial Sequence
  Synthetic Polynucleotide
atggacatcgtgatgacacagagccctgatagcctggccgtgtctctgggagagagagccaccatcaactgcaagagcagccagagcctgctgaacagccggaccagaaagaactacctggcctggtatcagcagaagcccggacagtctcccaagctgctgatctactggaccagcaccagaaagtccggcgtgcccgatagattttctggctctggcagcggcaccgacttcaccctgacaatttctagcctgcaagccgaggacgtggccgtgtactactgcaagcagagcttcatcctgcggacctttggccagggcaccaaggtggaaatcaaaggcggaggcggaagtggaggcggaggatctggcggcggaggctctgaagttcagctggttcagagcggagccgaagtgaagaaacctggggcctctgtgaaggtgtcctgcaaggcttccggcttcaccttcaccagctactacatccactgggtccgacaggcccctggacaaggactggaatggatcggctggatctaccccgagaacgacaacaccaagtacaacgagaagttcaaggaccgcgtgaccatcaccgccgataccagcacaagcaccgcctacctggaactgagcagcctgagaagcgaggacaccgccgtgtattattgcgccagagatgcctacagccggtactacttcgactactggggccagggaaccctggtcacagtctcttctaaggatgagctg

SEQ ID NO: 697 - DNA, 762 bp, Artificial Sequence
  Synthetic Polynucleotide
atggacatcgtgatgacacagagccctctgagcctgcctgtgacacctggcgaacctgccagcatcagctgtagaagcagccagagactgctgagcagctacggccacacatacctgcactggtatctccagaagcctggacagagcccacagctgctgatctacgaggtgtccaacagattcagcggcgtgcccgatagattttccggctctggcagcggcaccgacttcaccctgaagattagcagagtggaagccgaggacgtgggcgtgtactactgtagccagagcacacacgtgcccctgacctttggacagggcaccaaggtggaaatcaaaggcggaggcggaagtggaggcggaggatctggcggcggaggctctgaagtgcagctggttgaatctggcggcggactggttaagcctggcggatctctgagactgagctgtgccgccagcggctacaccttcagcaattactggatcggctgggtccgacaggcccctggaaaaggactggaatggatcggcgacatctaccctggcggcaactacatcagaaacaacgagaagttcaaggacaagaccacactgagcgccgacaccagcaagaacacagcctacctccagatgaacagcctgaaaaccgaggacaccgccgtgtactattgcggcagcagcttcggcagcaactacgtgttcgcctggttcacctattggggccagggcacactggtcaccgttagctctaaggatgagctg

SEQ ID NO: 698 - DNA, 756 bp, Artificial Sequence
  Synthetic Polynucleotide
atggacatcgtgatgtctcagagccctagcagcctggctgtgtccgctggcgagaaagtgaccatgagctgcaagagcagccagagcctgttcaacagccggaccagaaagaactacctggcctggtatcagcagaagcccggacagtctcccaagctgctgatctactgggccagcgccagagatagcggagtgcctgctagattcacaggcagcggcagcgagacatacttcaccctgaccatcagcagagtgcaggccgaggatctggccgtgtactactgtatgcagagcttcaacctgcggaccttcggcggaggcaccaagctggaaatcaaaggcggaggcggaagtggaggcggaggatctggcggcggaggctctgaagtgaacctggttgaatccggcggaggactggttcagcctggcggatctctgagactgagctgtgccaccagcggcttcaccttcaccgacaactacatgagctgggtccgacagcctcctggcaaagctctggaatggctgggcttcatcagaaacaaggccaacggctacaccaccgactacagcgcctctgtgcggggcagattcaccatctccagagacaacagccagtccatcctgtacctccagatgaacgccctgagagccgaggatagcgccacctactactgtgccagagatgtgggcagcaactacttcgactattggggccagggcaccacactgaccgttagctctaaggatgagctg

SEQ ID NO: 699 - DNA, 759 bp, Artificial Sequence
  Synthetic Polynucleotide
atggacatcgtgatgacacagagccctgatagcctggccgtgtctctcggcgagcgcgtgacaatgaattgcaagagcagccagagcctgctgtactccaccaaccagaagaactacctggcctggtatcagcagaagcccggacagtctcccaagctgctgatctactgggccagcaccagagaaagcggcgtgcccgatagattttctggctctggcagcggcaccgacttcaccctgacaatcagttctgtgcaggccgaggacgtggccgtgtactactgccagcagtattacagctaccggaccttcggcggaggcaccaagctggaaatcaaaggcggaggcggaagtggaggcggaggatctggcggcggaggctctcaagttcagctccagcagtctggccccgagtggaaacctggcgcttctgtgaagatgagctgcaaggccagcggctacaccttcaccagctacgtgatccactgggtccgacagaagcctggccaaggactggattggatcggctacatcaacccctacaacgacggcaccgattacgacgagaagttcaagggcaaagccacactgaccagcgacaccagcacaagcaccgcctacatggaactgagcagcctgagaagcgaggacaccgccgtgtattattgcgccagagagaaggacaactacgccaccggcgcttggtttgcctattggggccagggaacactggtcaccgttagctctaaggatgagctg

SEQ ID NO: 700 - DNA, 747 bp, Artificial Sequence
  Synthetic Polynucleotide
atggacatccagatgacacagagccctagcagcctgtctgccagcgtgggagacagagtgaccatcacctgtagagccagccaggacatcagaaactacctgaactggtatcagcagaagcccggcaaggcccctaagctgctgatctactacaccagcagactggaaagcggcgtgcccagcagattttctggcagcggctctggcaccgactacaccctgacaatatccagcctccagcctgaggacttcgccacctactattgccagcagggcaacaccctgccttggacatttggccagggcaccaaggtggaaatcaaaggcggaggcggaagtggaggcggaggatctggcggcggaggctctgaagtgcagctggttgaatcaggtggcggcctggttcaacctggcggatctctgagactgagctgtgccgccagcggctacagctttaccggctacaccatgaactgggtccgacaggcccctggcaaaggactggaatgggtcgccctgattaacccctacaagggcgtgtccacctacaaccagaagttcaaggacaggttcaccatcagcgtggacaagagcaagaacaccgcctacctccagatgaactccctgagagccgaggacaccgccgtgtactattgtgccagaagcggctactacggcgacagcgactggtactttgatgtgtggggccagggaaccctggtcaccgtttcttctaaggatgagctg

SEQ ID NO: 701 - DNA, 753 bp, Artificial Sequence
  Synthetic Polynucleotide
atgagcacaggatctcaggtgcagctccagcagtctggccctgagcttgtgaaacctggcgcttccgtgaagatgagctgcaaggccagcggctacaccttcaccgactatgtgattaactggggcaagcagcggagcggccaaggactggaatggatcggcgaaatctaccctggcagcggcaccaactactacaacgagaagttcaaggccaaggccacactgaccgccgacaagagcagcaatatcgcctacatgcagctgagcagcctgaccagcgaagatagcgccgtgtacttctgcgccagaagaggcagatacggcctgtacgctatggactattggggccagggcaccagcgtgacagtgtcatctggcggaggcggaagtggaggcggaggatctggcggcggaggctctgacatccagatgacccagacaaccagcagcctgtctgccagcctgggcgatagagtgaccatcagctgtagagccagccaggacatcagcaactacctgaactggtatcagcagaaacccgacggcaccgtgaagctgctgatctactacaccagcagactgcacagcggcgtgcccagcagattttctggctctggaagcggcacagattactccctgaccatcaacaacctggaacaagaggacattgccacctacttttgccagcaaggcaacacccggccttggacatttggcggaggcaccaagctggaaatcaagaaggatgagctg

SEQ ID NO: 702 - DNA, 738 bp, Artificial Sequence
  Synthetic Polynucleotide
atgcagatcgtgctgacacagagccctgccatcatgagcgcttccccaggcgagaaagtgaccatgacctgtagcgccacaagcagcgtgtcctacatgcactggtatcagcagaagtccggcacaagccccaagcggtggatctacgataccagcaaactggcctctggcgtgcccgctagattttctggctctggcagcggcaccagctacagcctgacaatcagcagcatggaagccgaggatgccgccacctactactgccagcagtggtccagcaatcccctgacatttggagccggcaccaagctggaactgaaaggcggaggcggaagtggaggcggaggatctggcggcggaggctctgaagttcagctccagcagtctggccccgagcttgtgaaacctggcgcttccgtgaagatgagctgcaaggccagcggctacaagttcacctcctacgtgatgcactgggtcaagcagaaacccggccagggccttgagtggatcggctacatcaacccctacaacgacgtgaccaagtacaacgagaagttcaagggcaaagccacactgaccagcgacaagagcagcagcaccgcctacatggaactgagcagcctgacctctgaggacagcgccgtgcactattgtgccagaggcagctactacgactacgacggctttgtgtattggggccagggcaccctggttaccgtttctgctaaggatgagctg

SEQ ID NO: 703 - DNA, 741 bp, Artificial Sequence
  Synthetic Polynucleotide
atggacatccagatgacacagagccctgccagccagtctgcctctctgggagagtctgtgaccatcacctgtctggcctctcagaccatcggaacatggctggcctggtatcagcagaagcctggcaagtctccccagctgctgatctacgccgctacatctctggctgatggcgtgcccagcagattttctggcagcggctccggcaccaagttcagcctgaagatcagaaccctccaggccgaggacttcgtgtcctactattgccagcagctgtactccaagccttacacctttggcggaggcaccaagctggaaatcaagagaggcggaggcggaagtggaggcggaggatctggcggcggaggctctgaagttcagctgcaacagagcggagccgagctggttaagcctggcgcttctgtgaagctgagctgtacccctagcggcttcaacgtgaaggacacctacatccactgggtcaagcagcggcctaagcagggcctcgaatggatcggaagaatcgaccctagcgacggcgacattaagtacgaccccaagttccagggcaaagccaccatcaccgccgacaccagcagcaacacagtgtctctccagctgagcagcctgaccagcgaagataccgccgtgtactattgcgcccgttggttcggcgattacggggccatgaattattggggccagggcaccagcgtgaccgtgtcatctaaggatgagctg

SEQ ID NO: 704 - skipped

SEQ ID NO: 705 - DNA, 747 bp, Artificial Sequence
  Synthetic Polynucleotide
atggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctctcaccatcaccatcatcac

SEQ ID NO: 706 - DNA, 747 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtcaccatcaccatcatcac

SEQ ID NO: 707 - DNA, 747 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtcaccatcaccatcatcac

SEQ ID NO: 708 - DNA, 750 bp, Artificial Sequence
  Synthetic Polynucleotide
atggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtcaccatcaccatcatcac

SEQ ID NO: 709 - DNA, 771 bp, Artificial Sequence
  Synthetic Polynucleotide
atggacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtcaccatcaccatcatcac

SEQ ID NO: 710 - DNA, 822 bp, Artificial Sequence
  Synthetic Polynucleotide
atgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctcaccatcaccatcatcac

SEQ ID NO: 711 - DNA, 753 bp, Artificial Sequence
  Synthetic Polynucleotide
atggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtcaccatcaccatcatcac

SEQ ID NO: 712 - DNA, 750 bp, Artificial Sequence
  Synthetic Polynucleotide
atgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtcaccatcaccatcatcac

SEQ ID NO: 713 - DNA, 768 bp, Artificial Sequence
  Synthetic Polynucleotide
atgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctcaccatcaccatcatcac

SEQ ID NO: 714 - DNA, 783 bp, Artificial Sequence
  Synthetic Polynucleotide
atgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctcaccatcaccatcatcac

SEQ ID NO: 715 - DNA, 744 bp, Artificial Sequence
  Synthetic Polynucleotide
atggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctcaccatcaccatcatcac

SEQ ID NO: 716 - DNA, 774 bp, Artificial Sequence
  Synthetic Polynucleotide
atggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctcaccatcaccatcatcac

SEQ ID NO: 717 - DNA, 747 bp, Artificial Sequence
  Synthetic Polynucleotide
atggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtcaccatcaccatcatcac

SEQ ID NO: 718 - DNA, 759 bp, Artificial Sequence
  Synthetic Polynucleotide
atggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcacaccatcaccatcatcac

SEQ ID NO: 719 - DNA, 753 bp, Artificial Sequence
  Synthetic Polynucleotide
atggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagccaccatcaccatcatcac

SEQ ID NO: 720 - DNA, 753 bp, Artificial Sequence
  Synthetic Polynucleotide
atggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctcaccatcaccatcatcac

SEQ ID NO: 721 - DNA, 756 bp, Artificial Sequence
  Synthetic Polynucleotide
atgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctcaccatcaccatcatcac

SEQ ID NO: 722 - DNA, 750 bp, Artificial Sequence
  Synthetic Polynucleotide
atgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctcaccatcaccatcatcac

SEQ ID NO: 723 - DNA, 783 bp, Artificial Sequence
  Synthetic Polynucleotide
atgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctcaccatcaccatcatcac

SEQ ID NO: 724 - DNA, 750 bp, Artificial Sequence
  Synthetic Polynucleotide
atggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctcaccatcaccatcatcac

SEQ ID NO: 725 - DNA, 753 bp, Artificial Sequence
  Synthetic Polynucleotide
atggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtcaccatcaccatcatcac

SEQ ID NO: 726 - DNA, 756 bp, Artificial Sequence
  Synthetic Polynucleotide
atggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctcaccatcaccatcatcac

SEQ ID NO: 727 - DNA, 756 bp, Artificial Sequence
  Synthetic Polynucleotide
atggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagccaccatcaccatcatcac

SEQ ID NO: 728 - DNA, 756 bp, Artificial Sequence; identical to SEQ ID NO: 727
  Synthetic Polynucleotide

SEQ ID NO: 729 - DNA, 756 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctcaccatcaccatcatcac

SEQ ID NO: 730 - DNA, 762 bp, Artificial Sequence
  Synthetic Polynucleotide
atggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagccaccatcaccatcatcac

SEQ ID NO: 731 - DNA, 753 bp, Artificial Sequence
  Synthetic Polynucleotide
atggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctcaccatcaccatcatcac

SEQ ID NO: 732 - DNA, 762 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctcaccatcaccatcatcac

SEQ ID NO: 733 - DNA, 756 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctcaccatcaccatcatcac

SEQ ID NO: 734 - DNA, 753 bp, Artificial Sequence
  Synthetic Polynucleotide
atggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctcaccatcaccatcatcac

SEQ ID NO: 735 - DNA, 783 bp, Artificial Sequence
  Synthetic Polynucleotide
atgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaacccaccatcaccatcatcac

SEQ ID NO: 736 - DNA, 759 bp, Artificial Sequence
  Synthetic Polynucleotide
atgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagccaccatcaccatcatcac

SEQ ID NO: 737 - DNA, 753 bp, Artificial Sequence; identical to SEQ ID NO: 734
  Synthetic Polynucleotide

SEQ ID NO: 738 - DNA, 750 bp, Artificial Sequence
  Synthetic Polynucleotide
atggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctcaccatcaccatcatcac

SEQ ID NO: 739 - DNA, 756 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctcaccatcaccatcatcac

SEQ ID NO: 740 - DNA, 750 bp, Artificial Sequence
  Synthetic Polynucleotide
atggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctcaccatcaccatcatcac

SEQ ID NO: 741 - DNA, 765 bp, Artificial Sequence
  Synthetic Polynucleotide
atggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagccaccatcaccatcatcac

SEQ ID NO: 742 - DNA, 741 bp, Artificial Sequence
  Synthetic Polynucleotide
atggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctcaccatcaccatcatcac

SEQ ID NO: 743 - DNA, 759 bp, Artificial Sequence
  Synthetic Polynucleotide
atggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagccaccatcaccatcatcac

SEQ ID NO: 744 - DNA, 759 bp, Artificial Sequence
  Synthetic Polynucleotide
atgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagcaccatcaccatcatcac

SEQ ID NO: 745 - DNA, 738 bp, Artificial Sequence
  Synthetic Polynucleotide
atggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagccaccatcaccatcatcac

SEQ ID NO: 746 - DNA, 753 bp, Artificial Sequence
  Synthetic Polynucleotide
atggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctcaccatcaccatcatcac

SEQ ID NO: 747 - DNA, 744 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctcaccatcaccatcatcac

SEQ ID NO: 748 - DNA, 774 bp, Artificial Sequence
  Synthetic Polynucleotide
atggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctcaccatcaccatcatcac

SEQ ID NO: 749 - DNA, 762 bp, Artificial Sequence
  Synthetic Polynucleotide
atggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctcaccatcaccatcatcac

SEQ ID NO: 750 - DNA, 840 bp, Artificial Sequence
  Synthetic Polynucleotide
atgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctcccaccatcaccatcatcac

SEQ ID NO: 751 - DNA, 837 bp, Artificial Sequence
  Synthetic Polynucleotide
atgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagacaccatcaccatcatcac

SEQ ID NO: 752 - DNA, 885 bp, Artificial Sequence
  Synthetic Polynucleotide
atggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatccaccatcaccatcatcac

SEQ ID NO: 753 - DNA, 753 bp, Artificial Sequence
  Synthetic Polynucleotide
atggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctcaccatcaccatcatcac

SEQ ID NO: 754 - DNA, 750 bp, Artificial Sequence
  Synthetic Polynucleotide
atggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagccaccatcaccatcatcac

SEQ ID NO: 755 - DNA, 741 bp, Artificial Sequence
  Synthetic Polynucleotide
atggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctcaccatcaccatcatcac

SEQ ID NO: 756 - DNA, 771 bp, Artificial Sequence
  Synthetic Polynucleotide
atggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctcaccatcaccatcatcac

SEQ ID NO: 757 - DNA, 732 bp, Artificial Sequence
  Synthetic Polynucleotide
atggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctcaccatcaccatcatcac

SEQ ID NO: 758 - DNA, 756 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctcaccatcaccatcatcac

SEQ ID NO: 759 - DNA, 744 bp, Artificial Sequence
  Synthetic Polynucleotide
atggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagccaccatcaccatcatcac

SEQ ID NO: 760 - DNA, 756 bp, Artificial Sequence
  Synthetic Polynucleotide
atggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcacaccatcaccatcatcac

SEQ ID NO: 761 - DNA, 744 bp, Artificial Sequence
  Synthetic Polynucleotide
atggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtcaccatcaccatcatcac

SEQ ID NO: 762 - DNA, 768 bp, Artificial Sequence
  Synthetic Polynucleotide
atggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagccaccatcaccatcatcac

SEQ ID NO: 763 - DNA, 753 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctcaccatcaccatcatcac

SEQ ID NO: 764 - DNA, 765 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctcaccatcaccatcatcac

SEQ ID NO: 765 - DNA, 765 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctcaccatcaccatcatcac

SEQ ID NO: 766 - DNA, 747 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtcaccatcaccatcatcac

SEQ ID NO: 767 - DNA, 753 bp, Artificial Sequence
  Synthetic Polynucleotide
atgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctcaccatcaccatcatcac

SEQ ID NO: 768 - DNA, 744 bp, Artificial Sequence
  Synthetic Polynucleotide
atggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctcaccatcaccatcatcac

SEQ ID NO: 769 - DNA, 747 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctcaccatcaccatcatcac

SEQ ID NO: 770 - DNA, 735 bp, Artificial Sequence
  Synthetic Polynucleotide
atggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtcaccatcaccatcatcac

SEQ ID NO: 771 - DNA, 828 bp, Artificial Sequence
  Synthetic Polynucleotide
atgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctcaccatcaccatcatcac

SEQ ID NO: 772 - DNA, 741 bp, Artificial Sequence
  Synthetic Polynucleotide
atggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtcaccatcaccatcatcac

SEQ ID NO: 773 - DNA, 768 bp, Artificial Sequence
  Synthetic Polynucleotide
atggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctcaccatcaccatcatcac

SEQ ID NO: 774 - DNA, 780 bp, Artificial Sequence
  Synthetic Polynucleotide
atggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctcaccatcaccatcatcac

SEQ ID NO: 775 - DNA, 753 bp, Artificial Sequence
  Synthetic Polynucleotide
atggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagccaccatcaccatcatcac

SEQ ID NO: 776 - DNA, 738 bp, Artificial Sequence
  Synthetic Polynucleotide
atggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctcaccatcaccatcatcac

SEQ ID NO: 777 - DNA, 747 bp, Artificial Sequence
  Synthetic Polynucleotide
atggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagccaccatcaccatcatcac

SEQ ID NO: 778 - DNA, 732 bp, Artificial Sequence
  Synthetic Polynucleotide
atgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctcaccatcaccatcatcac

SEQ ID NO: 779 - DNA, 762 bp, Artificial Sequence
  Synthetic Polynucleotide
atggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtcaccatcaccatcatcac

SEQ ID NO: 780 - DNA, 738 bp, Artificial Sequence
  Synthetic Polynucleotide
atggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctcaccatcaccatcatcac

SEQ ID NO: 781 - DNA, 747 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctcaccatcaccatcatcac

SEQ ID NO: 782 - DNA, 777 bp, Artificial Sequence
  Synthetic Polynucleotide
atggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtcaccatcaccatcatcac

SEQ ID NO: 783 - DNA, 768 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctcaccatcaccatcatcac

SEQ ID NO: 784 - DNA, 744 bp, Artificial Sequence
  Synthetic Polynucleotide
atggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctcaccatcaccatcatcac

SEQ ID NO: 785 - DNA, 723 bp, Artificial Sequence
  Synthetic Polynucleotide
atgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctcaccatcaccatcatcac

SEQ ID NO: 786 - DNA, 738 bp, Artificial Sequence
  Synthetic Polynucleotide
atgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctcaccatcaccatcatcac

SEQ ID NO: 787 - DNA, 747 bp, Artificial Sequence
  Synthetic Polynucleotide
atggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctcaccatcaccatcatcac

SEQ ID NO: 788 - DNA, 762 bp, Artificial Sequence
  Synthetic Polynucleotide
atggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctcaccatcaccatcatcac

SEQ ID NO: 789 - DNA, 747 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtcaccatcaccatcatcac

SEQ ID NO: 790 - DNA, 765 bp, Artificial Sequence
  Synthetic Polynucleotide
atggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctcaccatcaccatcatcac

SEQ ID NO: 791 - DNA, 759 bp, Artificial Sequence
  Synthetic Polynucleotide
atggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctcaccatcaccatcatcac

SEQ ID NO: 792 - DNA, 759 bp, Artificial Sequence
  Synthetic Polynucleotide
atggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctcaccatcaccatcatcac

SEQ ID NO: 793 - DNA, 753 bp, Artificial Sequence
  Synthetic Polynucleotide
atggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcacaccatcaccatcatcac

SEQ ID NO: 794 - DNA, 744 bp, Artificial Sequence
  Synthetic Polynucleotide
atggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctcaccatcaccatcatcac

SEQ ID NO: 795 - DNA, 747 bp, Artificial Sequence
  Synthetic Polynucleotide
atggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagccaccatcaccatcatcac

SEQ ID NO: 796 - DNA, 753 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctcaccatcaccatcatcac

SEQ ID NO: 797 - DNA, 756 bp, Artificial Sequence
  Synthetic Polynucleotide
atggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctcaccatcaccatcatcac

SEQ ID NO: 798 - DNA, 756 bp, Artificial Sequence
  Synthetic Polynucleotide
atggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctcaccatcaccatcatcac

SEQ ID NO: 799 - DNA, 756 bp, Artificial Sequence
  Synthetic Polynucleotide
atggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctcaccatcaccatcatcac

SEQ ID NO: 800 - DNA, 750 bp, Artificial Sequence
  Synthetic Polynucleotide
atggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctcaccatcaccatcatcac

SEQ ID NO: 801 - DNA, 750 bp, Artificial Sequence
  Synthetic Polynucleotide
atggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctcaccatcaccatcatcac

SEQ ID NO: 802 - DNA, 765 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagccaccatcaccatcatcac

SEQ ID NO: 803 - DNA, 765 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagccaccatcaccatcatcac

SEQ ID NO: 804 - DNA, 759 bp, Artificial Sequence
  Synthetic Polynucleotide
atggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtcaccatcaccatcatcac

SEQ ID NO: 805 - DNA, 744 bp, Artificial Sequence
  Synthetic Polynucleotide
atggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctcaccatcaccatcatcac

SEQ ID NO: 806 - DNA, 729 bp, Artificial Sequence
  Synthetic Polynucleotide
atggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctcaccatcaccatcatcac

SEQ ID NO: 807 - DNA, 747 bp, Artificial Sequence
  Synthetic Polynucleotide
atggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagcaccatcaccatcatcac

SEQ ID NO: 808 - DNA, 768 bp, Artificial Sequence
  Synthetic Polynucleotide
atggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtcaccatcaccatcatcac

SEQ ID NO: 809 - DNA, 771 bp, Artificial Sequence
  Synthetic Polynucleotide
atggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctcaccatcaccatcatcac

SEQ ID NO: 810 - DNA, 762 bp, Artificial Sequence
  Synthetic Polynucleotide
atggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtcaccatcaccatcatcac

SEQ ID NO: 811 - DNA, 753 bp, Artificial Sequence
  Synthetic Polynucleotide
atggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctcaccatcaccatcatcac

SEQ ID NO: 812 - DNA, 786 bp, Artificial Sequence
  Synthetic Polynucleotide
atggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacacaccatcaccatcatcac

SEQ ID NO: 813 - DNA, 774 bp, Artificial Sequence
  Synthetic Polynucleotide
atgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggacaccatcaccatcatcac

SEQ ID NO: 814 - DNA, 756 bp, Artificial Sequence
  Synthetic Polynucleotide
atggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtcaccatcaccatcatcac

SEQ ID NO: 815 - DNA, 747 bp, Artificial Sequence
  Synthetic Polynucleotide
atggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtcaccatcaccatcatcac

SEQ ID NO: 816 - DNA, 741 bp, Artificial Sequence
  Synthetic Polynucleotide
atggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctcaccatcaccatcatcac

SEQ ID NO: 817 - DNA, 747 bp, Artificial Sequence
  Synthetic Polynucleotide
atggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctcaccatcaccatcatcac

SEQ ID NO: 818 - DNA, 753 bp, Artificial Sequence
  Synthetic Polynucleotide
atgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctcaccatcaccatcatcac

SEQ ID NO: 819 - DNA, 768 bp, Artificial Sequence
  Synthetic Polynucleotide
atgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagccaccatcaccatcatcac

SEQ ID NO: 820 - DNA, 750 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctcaccatcaccatcatcac

SEQ ID NO: 821 - DNA, 753 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagccaccatcaccatcatcac

SEQ ID NO: 822 - DNA, 750 bp, Artificial Sequence
  Synthetic Polynucleotide
atgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctcaccatcaccatcatcac

SEQ ID NO: 823 - DNA, 747 bp, Artificial Sequence
  Synthetic Polynucleotide
atgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgcaccatcaccatcatcac

SEQ ID NO: 824 - DNA, 747 bp, Artificial Sequence
  Synthetic Polynucleotide
atgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctcaccatcaccatcatcac

SEQ ID NO: 825 - DNA, 753 bp, Artificial Sequence
  Synthetic Polynucleotide
atgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctcaccatcaccatcatcac

SEQ ID NO: 826 - DNA, 747 bp, Artificial Sequence
  Synthetic Polynucleotide
atggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctcaccatcaccatcatcac

SEQ ID NO: 827 - DNA, 744 bp, Artificial Sequence
  Synthetic Polynucleotide
atggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtcaccatcaccatcatcac

SEQ ID NO: 828 - DNA, 744 bp, Artificial Sequence
  Synthetic Polynucleotide
atggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctcaccatcaccatcatcac

SEQ ID NO: 829 - DNA, 768 bp, Artificial Sequence
  Synthetic Polynucleotide
atggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggaccccaccatcaccatcatcac

SEQ ID NO: 830 - DNA, 786 bp, Artificial Sequence
  Synthetic Polynucleotide
atgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagccaccatcaccatcatcac

SEQ ID NO: 831 - DNA, 741 bp, Artificial Sequence
  Synthetic Polynucleotide
atggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagccaccatcaccatcatcac

SEQ ID NO: 832 - DNA, 771 bp, Artificial Sequence
  Synthetic Polynucleotide
atggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcacaccatcaccatcatcac

SEQ ID NO: 833 - DNA, 759 bp, Artificial Sequence
  Synthetic Polynucleotide
atggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctcaccatcaccatcatcac

SEQ ID NO: 834 - DNA, 711 bp, Artificial Sequence
  Synthetic Polynucleotide
atggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagccaccatcaccatcatcac

SEQ ID NO: 835 - DNA, 741 bp, Artificial Sequence
  Synthetic Polynucleotide
atggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctcaccatcaccatcatcac

SEQ ID NO: 836 - DNA, 753 bp, Artificial Sequence
  Synthetic Polynucleotide
atggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctcaccatcaccatcatcac

SEQ ID NO: 837 - DNA, 741 bp, Artificial Sequence
  Synthetic Polynucleotide
atggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctcaccatcaccatcatcac

SEQ ID NO: 838 - DNA, 744 bp, Artificial Sequence
  Synthetic Polynucleotide
atggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctcaccatcaccatcatcac

SEQ ID NO: 839 - DNA, 759 bp, Artificial Sequence
  Synthetic Polynucleotide
atggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtcaccatcaccatcatcac

SEQ ID NO: 840 - DNA, 741 bp, Artificial Sequence
  Synthetic Polynucleotide
atggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctcaccatcaccatcatcac

SEQ ID NO: 841 - DNA, 744 bp, Artificial Sequence
  Synthetic Polynucleotide
atggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagcccaccatcaccatcatcac

SEQ ID NO: 842 - DNA, 768 bp, Artificial Sequence
  Synthetic Polynucleotide
atggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcacaccatcaccatcatcac

SEQ ID NO: 843 - DNA, 756 bp, Artificial Sequence; identical to SEQ ID NO: 760
  Synthetic Polynucleotide

SEQ ID NO: 844 - DNA, 747 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctcaccatcaccatcatcac

SEQ ID NO: 845 - DNA, 747 bp, Artificial Sequence
  Synthetic Polynucleotide
atggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctcaccatcaccatcatcac

SEQ ID NO: 846 - DNA, 744 bp, Artificial Sequence
  Synthetic Polynucleotide
atggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagccaccatcaccatcatcac

SEQ ID NO: 847 - DNA, 741 bp, Artificial Sequence
  Synthetic Polynucleotide
atggatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaaccaccatcaccatcatcac

SEQ ID NO: 848 - DNA, 744 bp, Artificial Sequence
  Synthetic Polynucleotide
atggacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctcaccatcaccatcatcac

SEQ ID NO: 849 - DNA, 756 bp, Artificial Sequence
  Synthetic Polynucleotide
atggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctcaccatcaccatcatcac

SEQ ID NO: 850 - DNA, 765 bp, Artificial Sequence
  Synthetic Polynucleotide
atggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagccaccatcaccatcatcac

SEQ ID NO: 851 - DNA, 771 bp, Artificial Sequence
  Synthetic Polynucleotide
atggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtcaccatcaccatcatcac

SEQ ID NO: 852 - DNA, 768 bp, Artificial Sequence
  Synthetic Polynucleotide
atggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtcaccatcaccatcatcac

SEQ ID NO: 853 - DNA, 738 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagccaccatcaccatcatcac

SEQ ID NO: 854 - DNA, 744 bp, Artificial Sequence
  Synthetic Polynucleotide
atggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctcaccatcaccatcatcac

SEQ ID NO: 855 - DNA, 744 bp, Artificial Sequence
  Synthetic Polynucleotide
atggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctcaccatcaccatcatcac

SEQ ID NO: 856 - DNA, 747 bp, Artificial Sequence
  Synthetic Polynucleotide
atggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtcaccatcaccatcatcac

SEQ ID NO: 857 - DNA, 741 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctcaccatcaccatcatcac

SEQ ID NO: 858 - DNA, 798 bp, Artificial Sequence
  Synthetic Polynucleotide
atggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtcaccatcaccatcatcac

SEQ ID NO: 859 - DNA, 789 bp, Artificial Sequence
  Synthetic Polynucleotide
atggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctcaccatcaccatcatcac

SEQ ID NO: 860 - DNA, 711 bp, Artificial Sequence
  Synthetic Polynucleotide
atggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctcaccatcaccatcatcac

SEQ ID NO: 861 - DNA, 759 bp, Artificial Sequence
  Synthetic Polynucleotide
atggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctcaccatcaccatcatcac

SEQ ID NO: 862 - DNA, 732 bp, Artificial Sequence
  Synthetic Polynucleotide
atggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtcaccatcaccatcatcac

SEQ ID NO: 863 - DNA, 735 bp, Artificial Sequence
  Synthetic Polynucleotide
atggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctcaccatcaccatcatcac

SEQ ID NO: 864 - DNA, 735 bp, Artificial Sequence
  Synthetic Polynucleotide
atggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctcaccatcaccatcatcac

SEQ ID NO: 865 - DNA, 768 bp, Artificial Sequence
  Synthetic Polynucleotide
atggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtcaccatcaccatcatcac

SEQ ID NO: 866 - DNA, 756 bp, Artificial Sequence
  Synthetic Polynucleotide
atgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtcaccatcaccatcatcac

SEQ ID NO: 867 - DNA, 741 bp, Artificial Sequence
  Synthetic Polynucleotide
atggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctcaccatcaccatcatcac

SEQ ID NO: 868 - DNA, 753 bp, Artificial Sequence
  Synthetic Polynucleotide
atggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctcaccatcaccatcatcac

SEQ ID NO: 869 - DNA, 780 bp, Artificial Sequence
  Synthetic Polynucleotide
atggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctcaccatcaccatcatcac

SEQ ID NO: 870 - DNA, 753 bp, Artificial Sequence
  Synthetic Polynucleotide
atggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctcaccatcaccatcatcac

SEQ ID NO: 871 - DNA, 762 bp, Artificial Sequence
  Synthetic Polynucleotide
atggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctcaccatcaccatcatcac

SEQ ID NO: 872 - DNA, 747 bp, Artificial Sequence
  Synthetic Polynucleotide
atggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctcaccatcaccatcatcac

SEQ ID NO: 873 - DNA, 750 bp, Artificial Sequence
  Synthetic Polynucleotide
atggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctcaccatcaccatcatcac

SEQ ID NO: 874 - DNA, 741 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctcaccatcaccatcatcac

SEQ ID NO: 875 - DNA, 777 bp, Artificial Sequence
  Synthetic Polynucleotide
atggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctcaccatcaccatcatcac

SEQ ID NO: 876 - DNA, 747 bp, Artificial Sequence
  Synthetic Polynucleotide
atggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctcaccatcaccatcatcac

SEQ ID NO: 877 - DNA, 738 bp, Artificial Sequence
  Synthetic Polynucleotide
atggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtcaccatcaccatcatcac

SEQ ID NO: 878 - DNA, 753 bp, Artificial Sequence
  Synthetic Polynucleotide
atggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagccaccatcaccatcatcac

SEQ ID NO: 879 - DNA, 750 bp, Artificial Sequence
  Synthetic Polynucleotide
atggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctcaccatcaccatcatcac

SEQ ID NO: 880 - DNA, 756 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctcaccatcaccatcatcac

SEQ ID NO: 881 - DNA, 744 bp, Artificial Sequence
  Synthetic Polynucleotide
atgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctcaccatcaccatcatcac

SEQ ID NO: 882 - DNA, 738 bp, Artificial Sequence
  Synthetic Polynucleotide
atggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctcaccatcaccatcatcac

SEQ ID NO: 883 - DNA, 771 bp, Artificial Sequence
  Synthetic Polynucleotide
atggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtcaccatcaccatcatcac

SEQ ID NO: 884 - DNA, 756 bp, Artificial Sequence
  Synthetic Polynucleotide
atggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagccaccatcaccatcatcac

SEQ ID NO: 885 - DNA, 759 bp, Artificial Sequence
  Synthetic Polynucleotide
atggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtcaccatcaccatcatcac

SEQ ID NO: 886 - DNA, 759 bp, Artificial Sequence
  Synthetic Polynucleotide
atggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctcaccatcaccatcatcac

SEQ ID NO: 887 - DNA, 759 bp, Artificial Sequence
  Synthetic Polynucleotide
atgcaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagccaccatcaccatcatcac

SEQ ID NO: 888 - DNA, 741 bp, Artificial Sequence
  Synthetic Polynucleotide
atggacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtcaccatcaccatcatcac

SEQ ID NO: 889 - DNA, 747 bp, Artificial Sequence
  Synthetic Polynucleotide
atggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtcaccatcaccatcatcac

SEQ ID NO: 890 - DNA, 744 bp, Artificial Sequence
  Synthetic Polynucleotide
atggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctcaccatcaccatcatcac

SEQ ID NO: 891 - DNA, 750 bp, Artificial Sequence
  Synthetic Polynucleotide
atggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctcaccatcaccatcatcac

SEQ ID NO: 892 - DNA, 723 bp, Artificial Sequence
  Synthetic Polynucleotide
atggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctcaccatcaccatcatcac

SEQ ID NO: 893 - DNA, 732 bp, Artificial Sequence
  Synthetic Polynucleotide
atggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctcaccatcaccatcatcac

SEQ ID NO: 894 - DNA, 753 bp, Artificial Sequence
  Synthetic Polynucleotide
atggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctcaccatcaccatcatcac

SEQ ID NO: 895 - DNA, 741 bp, Artificial Sequence
  Synthetic Polynucleotide
atggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctcaccatcaccatcatcac

SEQ ID NO: 896 - DNA, 744 bp, Artificial Sequence
  Synthetic Polynucleotide
atggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctcaccatcaccatcatcac

SEQ ID NO: 897 - DNA, 747 bp, Artificial Sequence
  Synthetic Polynucleotide
atggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctcaccatcaccatcatcac

SEQ ID NO: 898 - DNA, 762 bp, Artificial Sequence
  Synthetic Polynucleotide
atggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtcaccatcaccatcatcac

SEQ ID NO: 899 - DNA, 786 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctcaccatcaccatcatcacgagcagaaactgatctcggaagaggatctgtga

SEQ ID NO: 900 - DNA, 768 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacgccgcctaccctacttttggcggagggaccaaggttgagatcaaacggggcggaggcggaagtggaggcggaggatctggcggcggaggctctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggcggtgtactactgcgccagagagagttggccaatggacgtatggggccagggaacaactgtcaccgtctcctcacaccatcaccatcatcacgagcagaaactgatctcggaagaggatctgtga

SEQ ID NO: 901 - DNA, 783 bp, Artificial Sequence
  Synthetic Polynucleotide
atggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaaaggcggaggcggaagtggaggcggaggatctggcggcggaggctctcaaatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctcaccatcaccatcatcacgagcagaaactgatctcggaagaggatctgtga

SEQ ID NO: 902 - DNA, 774 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagaatctcctggcctttcacttttggcggagggaccaaggttgagatcaaaggcggaggcggaagtggaggcggaggatctggcggcggaggctctgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggcggtgtactactgcgcaagagccgagatgggagccgtattcgacatatggggtcagggtacaatggtcaccgtctcctcacaccatcaccatcatcacgagcagaaactgatctcggaagaggatctgtga

SEQ ID NO: 903 - DNA, 789 bp, Artificial Sequence
  Synthetic Polynucleotide
atggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagacacgtctggcctcctacttttggcggagggaccaaggttgagatcaaacggggcggaggcggaagtggaggcggaggatctggcggcggaggctctcagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagaggcaggggatatgcaaccagcttagccttcgatatctggggtcagggtacaatggtcaccgtctcctcacaccatcaccatcatcacgagcagaaactgatctcggaagaggatctgtga

SEQ ID NO: 904 - DNA, 804 bp, Artificial Sequence
  Synthetic Polynucleotide
atggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagggactcggcctccctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgccagagacggtacttatctaggtggtctctggtacttcgacttatgggggagaggtaccttggtcaccgtctcctcacaccatcaccatcatcacgagcagaaactgatctcggaagaggatctgtga

SEQ ID NO: 905 - DNA, 819 bp, Artificial Sequence
  Synthetic Polynucleotide
atggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgcccacactcctttcacttttggcggagggaccaaggttgagatcaaacggggcggaggcggaagtggaggcggaggatctggcggcggaggctctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagaactcctgaatactcctccagcatatggcactattactacggcatggacgtatggggccagggaacaactgtcaccgtctcctcacaccatcaccatcatcacgagcagaaactgatctcggaagaggatctgtga

SEQ ID NO: 906 - DNA, 792 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatagcgcatccaccagggccactggtatcccagccaggttcagtggcagtgggtctgggacagagttcactctcaccatcagcagcctgcagtctgaagattttgcagtttattactgtcagcagcaccacgtctggcctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgtcaaggggccgttgcaggagccgccatacgattatggaatggacgtatggggccagggaacaactgtcaccgtctcctcacaccatcaccatcatcacgagcagaaactgatctcggaagaggatctgtga

SEQ ID NO: 907 - DNA, 780 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattctactacccttggacttttggcggagggaccaaggttgagatcaaacggggcggaggcggaagtggaggcggaggatctggcggcggaggctctgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcaaccattagtagtagtagtagtaccatatactacgcagactctgtgaagggccgattcaccatctccagagacaatgccaagaactcactgtatctgcaaatgaacagcctgagagctgaggacacggcggtgtactactgcgccagaggttctcaggagcacctgattttcgattattggggacagggtacattggtcaccgtctcctcacaccatcaccatcatcacgagcagaaactgatctcggaagaggatctgtga

SEQ ID NO: 908 - DNA, 795 bp, Artificial Sequence
  Synthetic Polynucleotide
atggacatccagatgacacagagccctagcagcctgtctgccagcgtgggagacagagtgaccatcacctgtaccgccagcagcagagtgtccagcagctacctgcactggttccagcagaagcctggcaaggcccctaagctgctgatctacagcaccagcaatctggcctctggcgtgcccagcagattttctggctctggcagcggcaccgacttcaccctgacaatatctagcctccagcctgaggacttcgccacctactactgccaccagtaccacagaagcccctacacattcggccagggcaccaaggtggaaatcaagagaggcggaggcggaagtggaggcggaggatctggcggcggaggctctgaagttcagctggttgaatctggcggcggactggttcaacctggcggatctctgagactgagctgtgccgcctctggctacgccttcagcaacagctggatcaactgggtccgacaggcccctggcaaaggactggaatgggtcggacaaatctaccccggcgactacgacaccaactacaacggcaagttcaagggcagattcaccatcagccgggacaagagcaagaacaccgcctacctccagatgaactccctgagagccgaggacaccgccgtgtactattgtgctagaggcggctccatctactacggcaacctgggcttcttcgacgtgtggggacagggcacactggtcacagtctcttctcaccatcaccatcatcacgagcagaaactgatctcggaagaggatctgtga

SEQ ID NO: 909 - DNA, 765 bp, Artificial Sequence
  Synthetic Polynucleotide
atggacatccagatgacacagagccctagcagcctgtctgccagcgtgggagacagagtgaccatcacatgtagcgccagcagcagcgtgacctacatgtactggtatcagcagaagcccggcaaggcccctaagctgctgatctacgacaccagcaatctggcctctggcgtgcccagcagattttctggctctggcagcggcaccgactacaccctgacaatatctagcctccagcctgaggacttcgccacctactactgccagcagtggtccaactatcccctgacattcggccagggcaccaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacagcttcatcgagtacaccatcaactgggtccgacaggcccctggacaaggcctggaatggatcggcaacatcgacccctactacggcacaacctactacaaccagatgttcaccggcagagccacactgaccgtggacacctctatcagcaccgcctacatggaactgagccggctgagatccgatgacaccgccgtgtactattgtgccagaggcagcgcctggtttccctattggggacagggaaccctggtcaccgttagctctcaccatcaccatcatcacgagcagaaactgatctcggaagaggatctgtga

SEQ ID NO: 910 - DNA, 765 bp, Artificial Sequence
  Synthetic Polynucleotide
atggagatcgtgctgacacagagcccttctagcctgtctgccagcgtgggcgacagagtgaccatcacatgtagagccagcgagaacatctacagctacctggcctggtatcagcagaagcctggcaaggcccctaagctgctgatctacaacaccaagacactcggcgagggcgtgcccagcagattttctggttctggcagcggcaccgacttcaccctgaccatatctagcctgcagcctgaggacttcgccacctactactgccagcaccactacggcacccctttcacatttggccctggcaccaaggtggacatcaaaggcggaggcggaagtggaggcggaggatctggcggcggaggctctcaagttcagctggttcagagcggagccgaagtgaagaaacctggggcctctgtgaaggtgtcctgcaaggccagcggctacaccttcagcgactattgggtgcactgggtccgacaggctccaggacaaggactggaatggatgggagccatcgacggcagcgataccttcaacgattacagccagaaattcaaaggccgcgtgaccatgaccagagacaccagcatcagcaccgcctacatggaactgagccggctgagatccgatgacaccgccgtgtactattgtgccagaggcggcctgctgcagtattggggacagggaacactggtcaccgtgtcctctcaccatcaccatcatcacgagcagaaactgatctcggaagaggatctgtga

SEQ ID NO: 911 - DNA, 777 bp, Artificial Sequence
  Synthetic Polynucleotide
atggagatcgtgctgacacagtctcccgccacactgtcactgtctccaggcgaaagagccacactgagctgtagcgccagcagcagcgtgtcctacatgcactggtatcagcagaagcccggacaggcccctagactgctgatctacgataccagcaagctggcctctgacatccccgccagattttctggcagcggctctggcaccgatttcaccctgaccataagcagcctggaacctgaggacttcgccgtgtactactgtcagcagggcagcgtgtaccccttcacatttggcggcggaacaaaggtggaaatcaaaggcggaggcggaagtggaggcggaggatctggcggcggaggctctcaagttcagctgcaagagtctggccctggcctggttaagcctagcggaacactgagcctgacctgtgctgtgtctggcggcagcatcagcacatctggcatgggcgttggctgggtccgacagcctcctggaaaaggcctggaatggatcggccacatttggtgggacgacgacaagcggtacaaccccgctctgaagtccagagtgaccatcagcgtggacaagagcaagaaccagttcagcctgcggctgagcagcgtgacagctgcagataccgccgtgtattattgcgcccggatggaactgtggtcctactacttcgactactggggcaagggcaccaccgtgactgtctcttctcaccatcaccatcatcacgagcagaaactgatctcggaagaggatctgtga

SEQ ID NO: 912 - DNA, 789 bp, Artificial Sequence
  Synthetic Polynucleotide
atggacatccagatgacccagaccacaagcagcctgtctgccagcctgggcgacagagtgaccatctcttgtagagccagccaggacatcagcaactacctgaactggtatcagcagaaacccgacggcaccgtgaagctgctgatctactacaccagcatcctgcacagcggcgtgcccagcagattttctggctctggcagcggcaccgactacagcctgaccatcagcaatctggaacaagaggacttcgctacctacttctgccagcaaggcaacaccctgccttggacatttggcggaggcaccaagctggaaatcaaagctggcggaggcggaagtggaggcggaggatctggcggcggaggctctgaagtgcaactggttgaatctggcggcggactggttaagcctggcggatctctgaagctgagctgtgccgcctctggcttcgccttcagcatctacgatatgagctgggtccgacagacccctgagaagagactggaatgggtcgcctacatctctagcggcggagggacctactatcccgacacagtgaagggcagattcaccatctccagagacaacgccaagaacaccctgtacctccagatgagcagcctgaagtccgaggacaccgccatgtactactgcgccagacacagcggctatggcacacattggggagtgctgtttgcctactggggccagggaacactggtcacagtttctgctcaccatcaccatcatcacgagcagaaactgatctcggaagaggatctgtga

SEQ ID NO: 913 - DNA, 789 bp, Artificial Sequence
  Synthetic Polynucleotide
atggatattcaactgacacaatcccccagctcactcagcgccagcgtgggggacagggttagctttacctgtcaagcctctcaggatataaataactttctgaactggtatcaacagaagcctgggaaggcgcccaaactcctgatctatgatgcgtccaacctggaaactggcgtgccttcacgctttagcggctctggcagtggtacagacttcacttttaccatctcttcacttcagccggaggacatcgccacatattactgtcaacagtacggaaacttgccctttacttttggaggcggcaccaaagttgaaatcaaaagaggcggaggcggaagtggaggcggaggatctggcggcggaggctctcaggtccaactgcaagaaagcggacccggactggtgaagccttctgagacacttagtctgacgtgcacggtcagtggcggctccatctcctcctattattggtcatggatacgacaacccccaggtaagggcctggaatggattggctatatctactattcaggaagcacgaactacaatcccagcctgaagtcccgagtgacaatttcagtagataccagtaaaaaccagttcagtcttaaactgtcaagcgtgacagctgccgacaccgctgtgtattactgcgtctcactggtgtattgtggaggggattgttatagcgggttcgattattggggacagggaaccctggtgactgtatcttcccaccatcaccatcatcacgagcagaaactgatctcggaagaggatctgtga

SEQ ID NO: 914 - DNA, 795 bp, Artificial Sequence
  Synthetic Polynucleotide
atggatatccagctcactcaaagcccctctagtctctctgcctcagtgggggatcgggtcagttttacttgtcaagcttcacaggatatcaacaacttccttaattggtatcagcagaagccaggaaaagcacccaagctgctcatctatgatgcctcaaatttggagacgggtgttcccagtcgattctctgggtcagggtccgggaccgactttacgtttacgatctcctctctgcagcccgaagacatcgccacatactattgtcaacagtacggcaacttgcctttcacatttgggggcgggactaaggttgaaatcaagaggggcggaggcggaagtggaggcggaggatctggcggcggaggctctcaggtacagctgcaggaatctgggcccggacttgtcaagccaagtcagacactttctcttacatgtaccgtgagcggcggaagtataagcagtggaggcttttactggtcttggatacggcagcacccaggcaaaggcttggagtggattggatacattcatcattcaggatctacacactataatccatcccttaagtcccgggtcaccattagcattgatacgtctaagaatctgttcagtctcaggctgtcctccgtcactgctgccgacacagccgtgtactactgcgcctccttggtttactgcggaggcgactgttatagcggctttgattattgggggcaggggaccctcgtaaccgtgagctctcaccatcaccatcatcacgagcagaaactgatctcggaagaggatctgtga

SEQ ID NO: 915 - DNA, 795 bp, Artificial Sequence
  Synthetic Polynucleotide
atggacttcgtgatgacacagagccctctgagcctgcctgtgacacctggcgaacctgccagcatcagctgtagaagcagccagagcatcgtgcacagcaacggcaacacctacctggaatggtatctccagaagcctggacagagcccacagctgctgatctacaaggtgtccaacagattcagcggcgtgcccgacagattttctggcagcggctctggcaccgacttcaccctgaagattagcagagtggaagccgaggacgtgggcgtgtactactgcttccaaggctctcacgtgcccctgacctttggacagggcaccaagctggaaatcaagagaggcggaggcggaagtggaggcggaggatctggcggcggaggctctgaagtgcagctggttgaaagcggagccgaagtgaagaaacctggggcctctgtgaaggtgtcctgcaaggccagcggctacacctttaccagctactggattcactgggtccgacaggcccctggacaaggacttgagtggatgggcgagaacgacccctccaacggcaggaccaactacaacgagaagttcaagaaccgcgtgaccctgaccgtggacaccagcatctctaccgcctacatggaactgagccggctgagatccgatgacaccgccgtgtactattgcgccagaggacccaactacttttacagcatggactactggggccagggcacaatggtcaccgttagctctcaccatcaccatcatcacgagcagaaactgatctcggaagaggatctgtga

SEQ ID NO: 916 - DNA, 786 bp, Artificial Sequence
  Synthetic Polynucleotide
atggagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggcggaggcggaagtggaggcggaggatctggcggcggaggctctcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagccaccatcaccatcatcacgagcagaaactgatctcggaagaggatctgtga

SEQ ID NO: 917 - DNA, 786 bp, Artificial Sequence
  Synthetic Polynucleotide
atgcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggcggaggcggaagtggaggcggaggatctggcggcggaggctctgagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgccaccatcaccatcatcacgagcagaaactgatctcggaagaggatctgtga

SEQ ID NO: 918 - DNA, 804 bp, Artificial Sequence
  Synthetic Polynucleotide
atggacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggcggaggcggaagtggaggcggaggatctggcggcggaggctctcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagccaccatcaccatcatcacgagcagaaactgatctcggaagaggatctgtga

SEQ ID NO: 919 - DNA, 804 bp, Artificial Sequence
  Synthetic Polynucleotide
atgcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggcggaggcggaagtggaggcggaggatctggcggcggaggctctgacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggcaccatcaccatcatcacgagcagaaactgatctcggaagaggatctgtga

SEQ ID NO: 920 - DNA, 774 bp, Artificial Sequence
  Synthetic Polynucleotide
atggacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggcggaggcggaagtggaggcggaggatctggcggcggaggctctcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctcaccatcaccatcatcacgagcagaaactgatctcggaagaggatctgtga

SEQ ID NO: 921 - DNA, 774 bp, Artificial Sequence
  Synthetic Polynucleotide
atgcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggcggaggcggaagtggaggcggaggatctggcggcggaggctctgacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaacaccatcaccatcatcacgagcagaaactgatctcggaagaggatctgtga

SEQ ID NO: 922 - DNA, 751 bp, Artificial Sequence
  Synthetic Polynucleotide
atggagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtcaccatcaccatcatcacgagcagaaactgatctcggaagaggatctgtga

SEQ ID NO: 923 - DNA, 751 bp, Artificial Sequence; identical to SEQ ID NO: 922
  Synthetic Polynucleotide

SEQ ID NO: 924 - DNA, 763 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtcaccatcaccatcatcacgagcagaaactgatctcggaagaggatctgtga

SEQ ID NO: 925 - DNA, 763 bp, Artificial Sequence; identical to SEQ ID NO: 924
  Synthetic Polynucleotide

SEQ ID NO: 926 - DNA, 789 bp, Artificial Sequence
  Synthetic Polynucleotide
atggacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggcggaggcggaagtggaggcggaggatctggcggcggaggctctcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctcaccatcaccatcatcacgagcagaaactgatctcggaagaggatctgtga

SEQ ID NO: 927 - DNA, 789 bp, Artificial Sequence
  Synthetic Polynucleotide
atgcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggcggaggcggaagtggaggcggaggatctggcggcggaggctctgacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagacaccatcaccatcatcacgagcagaaactgatctcggaagaggatctgtga

SEQ ID NO: 928 - DNA, 798 bp, Artificial Sequence
  Synthetic Polynucleotide
atgcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggcggaggcggaagtggaggcggaggatctggcggcggaggctctcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtcaccatcaccatcatcacgagcagaaactgatctcggaagaggatctgtga

SEQ ID NO: 929 - DNA, 798 bp, Artificial Sequence
  Synthetic Polynucleotide
atgcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggcggaggcggaagtggaggcggaggatctggcggcggaggctctcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaacaccatcaccatcatcacgagcagaaactgatctcggaagaggatctgtga

SEQ ID NO: 930 - DNA, 774 bp, Artificial Sequence
  Synthetic Polynucleotide
atggacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggcggaggcggaagtggaggcggaggatctggcggcggaggctctcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctcaccatcaccatcatcacgagcagaaactgatctcggaagaggatctgtga

SEQ ID NO: 931 - DNA, 774 bp, Artificial Sequence
  Synthetic Polynucleotide
atgcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggcggaggcggaagtggaggcggaggatctggcggcggaggctctgacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagacaccatcaccatcatcacgagcagaaactgatctcggaagaggatctgtga

SEQ ID NO: 932 - DNA, 798 bp, Artificial Sequence
  Synthetic Polynucleotide
atggacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggcggaggcggaagtggaggcggaggatctggcggcggaggctctcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctcaccatcaccatcatcacgagcagaaactgatctcggaagaggatctgtga

SEQ ID NO: 933 - DNA, 798 bp, Artificial Sequence
  Synthetic Polynucleotide
atgcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggcggaggcggaagtggaggcggaggatctggcggcggaggctctgacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagacaccatcaccatcatcacgagcagaaactgatctcggaagaggatctgtga

SEQ ID NO: 934 - DNA, 783 bp, Artificial Sequence
  Synthetic Polynucleotide
atggacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggcggaggcggaagtggaggcggaggatctggcggcggaggctctgaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctcaccatcaccatcatcacgagcagaaactgatctcggaagaggatctgtga

SEQ ID NO: 935 - DNA, 783 bp, Artificial Sequence
  Synthetic Polynucleotide
atggaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggcggaggcggaagtggaggcggaggatctggcggcggaggctctgacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggcaccatcaccatcatcacgagcagaaactgatctcggaagaggatctgtga

SEQ ID NO: 936 - DNA, 774 bp, Artificial Sequence
  Synthetic Polynucleotide
atggacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctcaccatcaccatcatcacgagcagaaactgatctcggaagaggatctgtga

SEQ ID NO: 937 - DNA, 774 bp, Artificial Sequence
  Synthetic Polynucleotide
atggaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggcggaggcggaagtggaggcggaggatctggcggcggaggctctgacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagacaccatcaccatcatcacgagcagaaactgatctcggaagaggatctgtga

SEQ ID NO: 938 - DNA, 774 bp, Artificial Sequence
  Synthetic Polynucleotide
atggacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggcggaggcggaagtggaggcggaggatctggcggcggaggctctgaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctcaccatcaccatcatcacgagcagaaactgatctcggaagaggatctgtga

SEQ ID NO: 939 - DNA, 774 bp, Artificial Sequence
  Synthetic Polynucleotide
atggaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggcggaggcggaagtggaggcggaggatctggcggcggaggctctgacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttcaccatcaccatcatcacgagcagaaactgatctcggaagaggatctgtga

SEQ ID NO: 940 - DNA, 798 bp, Artificial Sequence
  Synthetic Polynucleotide
atgcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggcggaggcggaagtggaggcggaggatctggcggcggaggctctcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctcaccatcaccatcatcacgagcagaaactgatctcggaagaggatctgtga

SEQ ID NO: 941 - DNA, 798 bp, Artificial Sequence
  Synthetic Polynucleotide
atgcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggcggaggcggaagtggaggcggaggatctggcggcggaggctctcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggccaccatcaccatcatcacgagcagaaactgatctcggaagaggatctgtga

SEQ ID NO: 942 - DNA, 819 bp, Artificial Sequence
  Synthetic Polynucleotide
atggacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggcggaggcggaagtggaggcggaggatctggcggcggaggctctgaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctcaccatcaccatcatcacgagcagaaactgatctcggaagaggatctgtga

SEQ ID NO: 943 - DNA, 819 bp, Artificial Sequence
  Synthetic Polynucleotide
atggaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggcggaggcggaagtggaggcggaggatctggcggcggaggctctgacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttcaccatcaccatcatcacgagcagaaactgatctcggaagaggatctgtga

SEQ ID NO: 944 - DNA, 735 bp, Artificial Sequence
  Synthetic Polynucleotide
atggtcgtgatgacccagacccctctgagcctgagcgtgacactgggacagcctgccagcatcagctgcaagagcagccagagcctgctgcacagcgacggcaagacctacctgaactggctgcagcagaggccaggccagagccctcggagactgatctacctggtgtccaagctggacagcggcgtgcccgatagattttccggctctggcagcggcaccgacttcaccctgaagatcagccgggtggaagccgaggacgtgggcatctactactgttggcagggcacccacctgtggacctttggcggcggaacaaaggtggaaatcaagggcggaggcggaagtggaggcggaggatctggcggcggaggctctgaagtgcacctggtggaaagcggcggaggactggtgcagccagggggatctctgagactgtcttgtgccgccagcggcttcaccttcagcagatacggcatgagctgggtgcgccaggcccctggaaaaggactggaactggtggctatgatgaagaccaagggcggcagaacctactaccccgacagcgtgaagggccggttcaccatctcccgggacaacgccaagaacagcctgtacctgcagatgaactccctgcgggccgaggacaccgccatctactattgtgcctccgacggctactactggggccagggaacaaccgtcaccgtgtcctctcaccatcaccatcatcac

SEQ ID NO: 945 - DNA, 744 bp, Artificial Sequence
  Synthetic Polynucleotide
atggagatcgtgctgacacagtctcccgccacactgtcactgtctccaggcgaaagagccacactgagctgtagcgccaccagcagcgtgtcctacatgcactggtatcagcagaagcccggcaaggcccctaagcggtggatctacgataccagcaaactggcctctggcgtgcccagcagattttctggctctggcagcggcaccgagttcaccctgacaatatctagcctccagcctgaggacttcgccacctactactgccagcagtggtccagcaatcccctgacctttggacagggcaccaagctggaaatcaaaggcggaggcggaagtggaggcggaggatctggcggcggaggctctcaagttcagctggttcagtctggggccgaagtgaagaaacctggggcctctgtgaaggtgtcctgcaaggccagcggctacaagttcaccagctacgtgatgcactgggtccgacaggctccaggacaaggactggaatggatcggctacatcaacccctacaacgacgtgaccaagtacaacgagaagttcaagggcagagtgaccatcaccgccgacaagagcacaagcaccgcctacatggaactgagcagcctgagaagcgaggacaccgccgtgcactattgtgccagaggcagctactacgactacgacggctttgtgtattggggccagggcaccctggtcaccgtttcttctcaccatcaccatcatcac

SEQ ID NO: 946 - DNA, 759 bp, Artificial Sequence
  Synthetic Polynucleotide
atggacatcgtgatgacacagagccctgatagcctggccgtgtctctgggagagagagccaccatcaactgcaagagcagccagagcctgctgaacagccggaccagaaagaactacctggcctggtatcagcagaagcccggacagtctcccaagctgctgatctactggaccagcaccagaaagtccggcgtgcccgatagattttctggctctggcagcggcaccgacttcaccctgacaatttctagcctgcaagccgaggacgtggccgtgtactactgcaagcagagcttcatcctgcggacctttggccagggcaccaaggtggaaatcaaaggcggaggcggaagtggaggcggaggatctggcggcggaggctctgaagttcagctggttcagagcggagccgaagtgaagaaacctggggcctctgtgaaggtgtcctgcaaggcttccggcttcaccttcaccagctactacatccactgggtccgacaggcccctggacaaggactggaatggatcggctggatctaccccgagaacgacaacaccaagtacaacgagaagttcaaggaccgcgtgaccatcaccgccgataccagcacaagcaccgcctacctggaactgagcagcctgagaagcgaggacaccgccgtgtattattgcgccagagatgcctacagccggtactacttcgactactggggccagggaaccctggtcacagtctcttctcaccatcaccatcatcac

SEQ ID NO: 947 - DNA, 768 bp, Artificial Sequence
  Synthetic Polynucleotide
atggacatcgtgatgacacagagccctctgagcctgcctgtgacacctggcgaacctgccagcatcagctgtagaagcagccagagactgctgagcagctacggccacacatacctgcactggtatctccagaagcctggacagagcccacagctgctgatctacgaggtgtccaacagattcagcggcgtgcccgatagattttccggctctggcagcggcaccgacttcaccctgaagattagcagagtggaagccgaggacgtgggcgtgtactactgtagccagagcacacacgtgcccctgacctttggacagggcaccaaggtggaaatcaaaggcggaggcggaagtggaggcggaggatctggcggcggaggctctgaagtgcagctggttgaatctggcggcggactggttaagcctggcggatctctgagactgagctgtgccgccagcggctacaccttcagcaattactggatcggctgggtccgacaggcccctggaaaaggactggaatggatcggcgacatctaccctggcggcaactacatcagaaacaacgagaagttcaaggacaagaccacactgagcgccgacaccagcaagaacacagcctacctccagatgaacagcctgaaaaccgaggacaccgccgtgtactattgcggcagcagcttcggcagcaactacgtgttcgcctggttcacctattggggccagggcacactggtcaccgttagctctcaccatcaccatcatcac

SEQ ID NO: 948 - DNA, 762 bp, Artificial Sequence
  Synthetic Polynucleotide
atggacatcgtgatgtctcagagccctagcagcctggctgtgtccgctggcgagaaagtgaccatgagctgcaagagcagccagagcctgttcaacagccggaccagaaagaactacctggcctggtatcagcagaagcccggacagtctcccaagctgctgatctactgggccagcgccagagatagcggagtgcctgctagattcacaggcagcggcagcgagacatacttcaccctgaccatcagcagagtgcaggccgaggatctggccgtgtactactgtatgcagagcttcaacctgcggaccttcggcggaggcaccaagctggaaatcaaaggcggaggcggaagtggaggcggaggatctggcggcggaggctctgaagtgaacctggttgaatccggcggaggactggttcagcctggcggatctctgagactgagctgtgccaccagcggcttcaccttcaccgacaactacatgagctgggtccgacagcctcctggcaaagctctggaatggctgggcttcatcagaaacaaggccaacggctacaccaccgactacagcgcctctgtgcggggcagattcaccatctccagagacaacagccagtccatcctgtacctccagatgaacgccctgagagccgaggatagcgccacctactactgtgccagagatgtgggcagcaactacttcgactattggggccagggcaccacactgaccgttagctctcaccatcaccatcatcac

SEQ ID NO: 949 - DNA, 765 bp, Artificial Sequence
  Synthetic Polynucleotide
atggacatcgtgatgacacagagccctgatagcctggccgtgtctctcggcgagcgcgtgacaatgaattgcaagagcagccagagcctgctgtactccaccaaccagaagaactacctggcctggtatcagcagaagcccggacagtctcccaagctgctgatctactgggccagcaccagagaaagcggcgtgcccgatagattttctggctctggcagcggcaccgacttcaccctgacaatcagttctgtgcaggccgaggacgtggccgtgtactactgccagcagtattacagctaccggaccttcggcggaggcaccaagctggaaatcaaaggcggaggcggaagtggaggcggaggatctggcggcggaggctctcaagttcagctccagcagtctggccccgagtggaaacctggcgcttctgtgaagatgagctgcaaggccagcggctacaccttcaccagctacgtgatccactgggtccgacagaagcctggccaaggactggattggatcggctacatcaacccctacaacgacggcaccgattacgacgagaagttcaagggcaaagccacactgaccagcgacaccagcacaagcaccgcctacatggaactgagcagcctgagaagcgaggacaccgccgtgtattattgcgccagagagaaggacaactacgccaccggcgcttggtttgcctattggggccagggaacactggtcaccgttagctctcaccatcaccatcatcac

SEQ ID NO: 950 - DNA, 753 bp, Artificial Sequence
  Synthetic Polynucleotide
atggacatccagatgacacagagccctagcagcctgtctgccagcgtgggagacagagtgaccatcacctgtagagccagccaggacatcagaaactacctgaactggtatcagcagaagcccggcaaggcccctaagctgctgatctactacaccagcagactggaaagcggcgtgcccagcagattttctggcagcggctctggcaccgactacaccctgacaatatccagcctccagcctgaggacttcgccacctactattgccagcagggcaacaccctgccttggacatttggccagggcaccaaggtggaaatcaaaggcggaggcggaagtggaggcggaggatctggcggcggaggctctgaagtgcagctggttgaatcaggtggcggcctggttcaacctggcggatctctgagactgagctgtgccgccagcggctacagctttaccggctacaccatgaactgggtccgacaggcccctggcaaaggactggaatgggtcgccctgattaacccctacaagggcgtgtccacctacaaccagaagttcaaggacaggttcaccatcagcgtggacaagagcaagaacaccgcctacctccagatgaactccctgagagccgaggacaccgccgtgtactattgtgccagaagcggctactacggcgacagcgactggtactttgatgtgtggggccagggaaccctggtcaccgtttcttctcaccatcaccatcatcac

SEQ ID NO: 951 - DNA, 759 bp, Artificial Sequence
  Synthetic Polynucleotide
atgagcacaggatctcaggtgcagctccagcagtctggccctgagcttgtgaaacctggcgcttccgtgaagatgagctgcaaggccagcggctacaccttcaccgactatgtgattaactggggcaagcagcggagcggccaaggactggaatggatcggcgaaatctaccctggcagcggcaccaactactacaacgagaagttcaaggccaaggccacactgaccgccgacaagagcagcaatatcgcctacatgcagctgagcagcctgaccagcgaagatagcgccgtgtacttctgcgccagaagaggcagatacggcctgtacgctatggactattggggccagggcaccagcgtgacagtgtcatctggcggaggcggaagtggaggcggaggatctggcggcggaggctctgacatccagatgacccagacaaccagcagcctgtctgccagcctgggcgatagagtgaccatcagctgtagagccagccaggacatcagcaactacctgaactggtatcagcagaaacccgacggcaccgtgaagctgctgatctactacaccagcagactgcacagcggcgtgcccagcagattttctggctctggaagcggcacagattactccctgaccatcaacaacctggaacaagaggacattgccacctacttttgccagcaaggcaacacccggccttggacatttggcggaggcaccaagctggaaatcaagcaccatcaccatcatcac

SEQ ID NO: 952 - DNA, 744 bp, Artificial Sequence
  Synthetic Polynucleotide
atgcagatcgtgctgacacagagccctgccatcatgagcgcttccccaggcgagaaagtgaccatgacctgtagcgccacaagcagcgtgtcctacatgcactggtatcagcagaagtccggcacaagccccaagcggtggatctacgataccagcaaactggcctctggcgtgcccgctagattttctggctctggcagcggcaccagctacagcctgacaatcagcagcatggaagccgaggatgccgccacctactactgccagcagtggtccagcaatcccctgacatttggagccggcaccaagctggaactgaaaggcggaggcggaagtggaggcggaggatctggcggcggaggctctgaagttcagctccagcagtctggccccgagcttgtgaaacctggcgcttccgtgaagatgagctgcaaggccagcggctacaagttcacctcctacgtgatgcactgggtcaagcagaaacccggccagggccttgagtggatcggctacatcaacccctacaacgacgtgaccaagtacaacgagaagttcaagggcaaagccacactgaccagcgacaagagcagcagcaccgcctacatggaactgagcagcctgacctctgaggacagcgccgtgcactattgtgccagaggcagctactacgactacgacggctttgtgtattggggccagggcaccctggttaccgtttctgctcaccatcaccatcatcac

SEQ ID NO: 953 - DNA, 747 bp, Artificial Sequence
  Synthetic Polynucleotide
atggacatccagatgacacagagccctgccagccagtctgcctctctgggagagtctgtgaccatcacctgtctggcctctcagaccatcggaacatggctggcctggtatcagcagaagcctggcaagtctccccagctgctgatctacgccgctacatctctggctgatggcgtgcccagcagattttctggcagcggctccggcaccaagttcagcctgaagatcagaaccctccaggccgaggacttcgtgtcctactattgccagcagctgtactccaagccttacacctttggcggaggcaccaagctggaaatcaagagaggcggaggcggaagtggaggcggaggatctggcggcggaggctctgaagttcagctgcaacagagcggagccgagctggttaagcctggcgcttctgtgaagctgagctgtacccctagcggcttcaacgtgaaggacacctacatccactgggtcaagcagcggcctaagcagggcctcgaatggatcggaagaatcgaccctagcgacggcgacattaagtacgaccccaagttccagggcaaagccaccatcaccgccgacaccagcagcaacacagtgtctctccagctgagcagcctgaccagcgaagataccgccgtgtactattgcgcccgttggttcggcgattacggggccatgaattattggggccagggcaccagcgtgaccgtgtcatctcaccatcaccatcatcac

SEQ ID NO: 954 - skipped

SEQ ID NO: 955 - DNA, 1068 bp, Artificial Sequence
  Synthetic Polynucleotide
atggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 956 - DNA, 1068 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 957 - DNA, 1068 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 958 - DNA, 1071 bp, Artificial Sequence
  Synthetic Polynucleotide
atggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 959 - DNA, 1092 bp, Artificial Sequence
  Synthetic Polynucleotide
atggacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 960 - DNA, 1143 bp, Artificial Sequence
  Synthetic Polynucleotide
atgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 961 - DNA, 1074 bp, Artificial Sequence
  Synthetic Polynucleotide
atggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 962 - DNA, 1071 bp, Artificial Sequence
  Synthetic Polynucleotide
atgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 963 - DNA, 1089 bp, Artificial Sequence
  Synthetic Polynucleotide
atgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 964 - DNA, 1104 bp, Artificial Sequence
  Synthetic Polynucleotide
atgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 965 - DNA, 1065 bp, Artificial Sequence
  Synthetic Polynucleotide
atggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 966 - DNA, 1095 bp, Artificial Sequence
  Synthetic Polynucleotide
atggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 967 - DNA, 1068 bp, Artificial Sequence
  Synthetic Polynucleotide
atggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 968 - DNA, 1080 bp, Artificial Sequence
  Synthetic Polynucleotide
atggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 969 - DNA, 1074 bp, Artificial Sequence
  Synthetic Polynucleotide
atggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 970 - DNA, 1074 bp, Artificial Sequence
  Synthetic Polynucleotide
atggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 971 - DNA, 1077 bp, Artificial Sequence
  Synthetic Polynucleotide
atgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 972 - DNA, 1071 bp, Artificial Sequence
  Synthetic Polynucleotide
atgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 973 - DNA, 1104 bp, Artificial Sequence
  Synthetic Polynucleotide
atgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 974 - DNA, 1071 bp, Artificial Sequence
  Synthetic Polynucleotide
atggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 975 - DNA, 1074 bp, Artificial Sequence
  Synthetic Polynucleotide
atggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 976 - DNA, 1077 bp, Artificial Sequence
  Synthetic Polynucleotide
atggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 977 - DNA, 1077 bp, Artificial Sequence
  Synthetic Polynucleotide
atggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 978 - DNA, 1077 bp, Artificial Sequence; identical to SEQ ID NO: 977
  Synthetic Polynucleotide

SEQ ID NO: 979 - DNA, 1077 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 980 - DNA, 1083 bp, Artificial Sequence
  Synthetic Polynucleotide
atggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 981 - DNA, 1074 bp, Artificial Sequence
  Synthetic Polynucleotide
atggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 982 - DNA, 1083 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 983 - DNA, 1077 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 984 - DNA, 1074 bp, Artificial Sequence
  Synthetic Polynucleotide
atggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 985 - DNA, 1104 bp, Artificial Sequence
  Synthetic Polynucleotide
atgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 986 - DNA, 1080 bp, Artificial Sequence
  Synthetic Polynucleotide
atgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 987 - DNA, 1074 bp, Artificial Sequence; identical to SEQ ID NO: 984
  Synthetic Polynucleotide

SEQ ID NO: 988 - DNA, 1071 bp, Artificial Sequence
  Synthetic Polynucleotide
atggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 989 - DNA, 1077 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 990 - DNA, 1071 bp, Artificial Sequence
  Synthetic Polynucleotide
atggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 991 - DNA, 1086 bp, Artificial Sequence
  Synthetic Polynucleotide
atggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 992 - DNA, 1062 bp, Artificial Sequence
  Synthetic Polynucleotide
atggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 993 - DNA, 1080 bp, Artificial Sequence
  Synthetic Polynucleotide
atggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 994 - DNA, 1080 bp, Artificial Sequence
  Synthetic Polynucleotide
atgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 995 - DNA, 1059 bp, Artificial Sequence
  Synthetic Polynucleotide
atggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 996 - DNA, 1074 bp, Artificial Sequence
  Synthetic Polynucleotide
atggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 997 - DNA, 1065 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 998 - DNA, 1095 bp, Artificial Sequence
  Synthetic Polynucleotide
atggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 999 - DNA, 1083 bp, Artificial Sequence
  Synthetic Polynucleotide
atggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1000 - DNA, 1161 bp, Artificial Sequence
  Synthetic Polynucleotide
atgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1001 - DNA, 1158 bp, Artificial Sequence
  Synthetic Polynucleotide
atgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1002 - DNA, 1206 bp, Artificial Sequence
  Synthetic Polynucleotide
atggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1003 - DNA, 1074 bp, Artificial Sequence
  Synthetic Polynucleotide
atggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1004 - DNA, 1071 bp, Artificial Sequence
  Synthetic Polynucleotide
atggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1005 - DNA, 1062 bp, Artificial Sequence
  Synthetic Polynucleotide
atggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1006 - DNA, 1092 bp, Artificial Sequence
  Synthetic Polynucleotide
atggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1007 - DNA, 1053 bp, Artificial Sequence
  Synthetic Polynucleotide
atggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1008 - DNA, 1077 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1009 - DNA, 1065 bp, Artificial Sequence
  Synthetic Polynucleotide
atggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1010 - DNA, 1077 bp, Artificial Sequence
  Synthetic Polynucleotide
atggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1011 - DNA, 1065 bp, Artificial Sequence
  Synthetic Polynucleotide
atggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1012 - DNA, 1089 bp, Artificial Sequence
  Synthetic Polynucleotide
atggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1013 - DNA, 1074 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1014 - DNA, 1086 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1015 - DNA, 1086 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1016 - DNA, 1068 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1017 - DNA, 1074 bp, Artificial Sequence
  Synthetic Polynucleotide
atgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1018 - DNA, 1065 bp, Artificial Sequence
  Synthetic Polynucleotide
atggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1019 - DNA, 1068 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1020 - DNA, 1056 bp, Artificial Sequence
  Synthetic Polynucleotide
atggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1021 - DNA, 1149 bp, Artificial Sequence
  Synthetic Polynucleotide
atgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1022 - DNA, 1062 bp, Artificial Sequence
  Synthetic Polynucleotide
atggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1023 - DNA, 1089 bp, Artificial Sequence
  Synthetic Polynucleotide
atggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1024 - DNA, 1101 bp, Artificial Sequence
  Synthetic Polynucleotide
atggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1025 - DNA, 1074 bp, Artificial Sequence
  Synthetic Polynucleotide
atggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1026 - DNA, 1059 bp, Artificial Sequence
  Synthetic Polynucleotide
atggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1027 - DNA, 1068 bp, Artificial Sequence
  Synthetic Polynucleotide
atggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1028 - DNA, 1053 bp, Artificial Sequence
  Synthetic Polynucleotide
atgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1029 - DNA, 1083 bp, Artificial Sequence
  Synthetic Polynucleotide
atggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1030 - DNA, 1059 bp, Artificial Sequence
  Synthetic Polynucleotide
atggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1031 - DNA, 1068 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1032 - DNA, 1098 bp, Artificial Sequence
  Synthetic Polynucleotide
atggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1033 - DNA, 1089 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1034 - DNA, 1065 bp, Artificial Sequence
  Synthetic Polynucleotide
atggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1035 - DNA, 1044 bp, Artificial Sequence
  Synthetic Polynucleotide
atgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1036 - DNA, 1059 bp, Artificial Sequence
  Synthetic Polynucleotide
atgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1037 - DNA, 1068 bp, Artificial Sequence
  Synthetic Polynucleotide
atggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1038 - DNA, 1083 bp, Artificial Sequence
  Synthetic Polynucleotide
atggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1039 - DNA, 1068 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1040 - DNA, 1086 bp, Artificial Sequence
  Synthetic Polynucleotide
atggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1041 - DNA, 1080 bp, Artificial Sequence
  Synthetic Polynucleotide
atggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1042 - DNA, 1080 bp, Artificial Sequence
  Synthetic Polynucleotide
atggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1043 - DNA, 1074 bp, Artificial Sequence
  Synthetic Polynucleotide
atggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1044 - DNA, 1065 bp, Artificial Sequence
  Synthetic Polynucleotide
atggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1045 - DNA, 1068 bp, Artificial Sequence
  Synthetic Polynucleotide
atggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1046 - DNA, 1074 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1047 - DNA, 1077 bp, Artificial Sequence
  Synthetic Polynucleotide
atggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1048 - DNA, 1077 bp, Artificial Sequence
  Synthetic Polynucleotide
atggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1049 - DNA, 1077 bp, Artificial Sequence
  Synthetic Polynucleotide
atggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1050 - DNA, 1071 bp, Artificial Sequence
  Synthetic Polynucleotide
atggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1051 - DNA, 1071 bp, Artificial Sequence
  Synthetic Polynucleotide
atggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1052 - DNA, 1086 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1053 - DNA, 1086 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1054 - DNA, 1080 bp, Artificial Sequence
  Synthetic Polynucleotide
atggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1055 - DNA, 1065 bp, Artificial Sequence
  Synthetic Polynucleotide
atggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1056 - DNA, 1050 bp, Artificial Sequence
  Synthetic Polynucleotide
atggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1057 - DNA, 1068 bp, Artificial Sequence
  Synthetic Polynucleotide
atggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1058 - DNA, 1089 bp, Artificial Sequence
  Synthetic Polynucleotide
atggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1059 - DNA, 1092 bp, Artificial Sequence
  Synthetic Polynucleotide
atggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1060 - DNA, 1083 bp, Artificial Sequence
  Synthetic Polynucleotide
atggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1061 - DNA, 1074 bp, Artificial Sequence
  Synthetic Polynucleotide
atggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1062 - DNA, 1107 bp, Artificial Sequence
  Synthetic Polynucleotide
atggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1063 - DNA, 1095 bp, Artificial Sequence
  Synthetic Polynucleotide
atgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1064 - DNA, 1077 bp, Artificial Sequence
  Synthetic Polynucleotide
atggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1065 - DNA, 1068 bp, Artificial Sequence
  Synthetic Polynucleotide
atggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1066 - DNA, 1062 bp, Artificial Sequence
  Synthetic Polynucleotide
atggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1067 - DNA, 1068 bp, Artificial Sequence
  Synthetic Polynucleotide
atggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1068 - DNA, 1074 bp, Artificial Sequence
  Synthetic Polynucleotide
atgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1069 - DNA, 1089 bp, Artificial Sequence
  Synthetic Polynucleotide
atgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1070 - DNA, 1071 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1071 - DNA, 1074 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1072 - DNA, 1071 bp, Artificial Sequence
  Synthetic Polynucleotide
atgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1073 - DNA, 1068 bp, Artificial Sequence
  Synthetic Polynucleotide
atgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1074 - DNA, 1068 bp, Artificial Sequence
  Synthetic Polynucleotide
atgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1075 - DNA, 1074 bp, Artificial Sequence
  Synthetic Polynucleotide
atgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1076 - DNA, 1068 bp, Artificial Sequence
  Synthetic Polynucleotide
atggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1077 - DNA, 1065 bp, Artificial Sequence
  Synthetic Polynucleotide
atggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1078 - DNA, 1065 bp, Artificial Sequence
  Synthetic Polynucleotide
atggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1079 - DNA, 1089 bp, Artificial Sequence
  Synthetic Polynucleotide
atggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1080 - DNA, 1107 bp, Artificial Sequence
  Synthetic Polynucleotide
atgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1081 - DNA, 1062 bp, Artificial Sequence
  Synthetic Polynucleotide
atggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1082 - DNA, 1092 bp, Artificial Sequence
  Synthetic Polynucleotide
atggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1083 - DNA, 1080 bp, Artificial Sequence
  Synthetic Polynucleotide
atggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1084 - DNA, 1032 bp, Artificial Sequence
  Synthetic Polynucleotide
atggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1085 - DNA, 1062 bp, Artificial Sequence
  Synthetic Polynucleotide
atggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1086 - DNA, 1074 bp, Artificial Sequence
  Synthetic Polynucleotide
atggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1087 - DNA, 1062 bp, Artificial Sequence
  Synthetic Polynucleotide
atggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1088 - DNA, 1065 bp, Artificial Sequence
  Synthetic Polynucleotide
atggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1089 - DNA, 1080 bp, Artificial Sequence
  Synthetic Polynucleotide
atggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1090 - DNA, 1062 bp, Artificial Sequence
  Synthetic Polynucleotide
atggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1091 - DNA, 1065 bp, Artificial Sequence
  Synthetic Polynucleotide
atggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1092 - DNA, 1089 bp, Artificial Sequence
  Synthetic Polynucleotide
atggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1093 - DNA, 1077 bp, Artificial Sequence; identical to SEQ ID NO: 1010
  Synthetic Polynucleotide

SEQ ID NO: 1094 - DNA, 1068 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1095 - DNA, 1068 bp, Artificial Sequence
  Synthetic Polynucleotide
atggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1096 - DNA, 1065 bp, Artificial Sequence
  Synthetic Polynucleotide
atggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1097 - DNA, 1062 bp, Artificial Sequence
  Synthetic Polynucleotide
atggatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1098 - DNA, 1065 bp, Artificial Sequence
  Synthetic Polynucleotide
atggacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1099 - DNA, 1077 bp, Artificial Sequence
  Synthetic Polynucleotide
atggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1100 - DNA, 1086 bp, Artificial Sequence
  Synthetic Polynucleotide
atggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1101 - DNA, 1092 bp, Artificial Sequence
  Synthetic Polynucleotide
atggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1102 - DNA, 1089 bp, Artificial Sequence
  Synthetic Polynucleotide
atggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1103 - DNA, 1059 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1104 - DNA, 1065 bp, Artificial Sequence
  Synthetic Polynucleotide
atggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1105 - DNA, 1065 bp, Artificial Sequence
  Synthetic Polynucleotide
atggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1106 - DNA, 1068 bp, Artificial Sequence
  Synthetic Polynucleotide
atggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1107 - DNA, 1062 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1108 - DNA, 1119 bp, Artificial Sequence
  Synthetic Polynucleotide
atggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1109 - DNA, 1110 bp, Artificial Sequence
  Synthetic Polynucleotide
atggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1110 - DNA, 1032 bp, Artificial Sequence
  Synthetic Polynucleotide
atggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1111 - DNA, 1080 bp, Artificial Sequence
  Synthetic Polynucleotide
atggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1112 - DNA, 1053 bp, Artificial Sequence
  Synthetic Polynucleotide
atggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1113 - DNA, 1056 bp, Artificial Sequence
  Synthetic Polynucleotide
atggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1114 - DNA, 1056 bp, Artificial Sequence
  Synthetic Polynucleotide
atggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1115 - DNA, 1089 bp, Artificial Sequence
  Synthetic Polynucleotide
atggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1116 - DNA, 1077 bp, Artificial Sequence
  Synthetic Polynucleotide
atgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1117 - DNA, 1062 bp, Artificial Sequence
  Synthetic Polynucleotide
atggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1118 - DNA, 1074 bp, Artificial Sequence
  Synthetic Polynucleotide
atggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1119 - DNA, 1101 bp, Artificial Sequence
  Synthetic Polynucleotide
atggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1120 - DNA, 1074 bp, Artificial Sequence
  Synthetic Polynucleotide
atggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1121 - DNA, 1083 bp, Artificial Sequence
  Synthetic Polynucleotide
atggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1122 - DNA, 1068 bp, Artificial Sequence
  Synthetic Polynucleotide
atggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1123 - DNA, 1071 bp, Artificial Sequence
  Synthetic Polynucleotide
atggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1124 - DNA, 1062 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1125 - DNA, 1098 bp, Artificial Sequence
  Synthetic Polynucleotide
atggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1126 - DNA, 1068 bp, Artificial Sequence
  Synthetic Polynucleotide
atggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1127 - DNA, 1059 bp, Artificial Sequence
  Synthetic Polynucleotide
atggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1128 - DNA, 1074 bp, Artificial Sequence
  Synthetic Polynucleotide
atggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1129 - DNA, 1071 bp, Artificial Sequence
  Synthetic Polynucleotide
atggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1130 - DNA, 1077 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1131 - DNA, 1065 bp, Artificial Sequence
  Synthetic Polynucleotide
atgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1132 - DNA, 1059 bp, Artificial Sequence
  Synthetic Polynucleotide
atggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1133 - DNA, 1092 bp, Artificial Sequence
  Synthetic Polynucleotide
atggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1134 - DNA, 1077 bp, Artificial Sequence
  Synthetic Polynucleotide
atggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1135 - DNA, 1080 bp, Artificial Sequence
  Synthetic Polynucleotide
atggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1136 - DNA, 1080 bp, Artificial Sequence
  Synthetic Polynucleotide
atggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1137 - DNA, 1080 bp, Artificial Sequence
  Synthetic Polynucleotide
atgcaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1138 - DNA, 1062 bp, Artificial Sequence
  Synthetic Polynucleotide
atggacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1139 - DNA, 1068 bp, Artificial Sequence
  Synthetic Polynucleotide
atggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1140 - DNA, 1065 bp, Artificial Sequence
  Synthetic Polynucleotide
atggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1141 - DNA, 1071 bp, Artificial Sequence
  Synthetic Polynucleotide
atggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1142 - DNA, 1044 bp, Artificial Sequence
  Synthetic Polynucleotide
atggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1143 - DNA, 1053 bp, Artificial Sequence
  Synthetic Polynucleotide
atggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1144 - DNA, 1074 bp, Artificial Sequence
  Synthetic Polynucleotide
atggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1145 - DNA, 1062 bp, Artificial Sequence
  Synthetic Polynucleotide
atggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1146 - DNA, 1065 bp, Artificial Sequence
  Synthetic Polynucleotide
atggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1147 - DNA, 1068 bp, Artificial Sequence
  Synthetic Polynucleotide
atggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1148 - DNA, 1083 bp, Artificial Sequence
  Synthetic Polynucleotide
atggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1149 - DNA, 1107 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1150 - DNA, 1089 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacgccgcctaccctacttttggcggagggaccaaggttgagatcaaacggggcggaggcggaagtggaggcggaggatctggcggcggaggctctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggcggtgtactactgcgccagagagagttggccaatggacgtatggggccagggaacaactgtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1151 - DNA, 1104 bp, Artificial Sequence
  Synthetic Polynucleotide
atggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaaaggcggaggcggaagtggaggcggaggatctggcggcggaggctctcaaatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1152 - DNA, 1095 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagaatctcctggcctttcacttttggcggagggaccaaggttgagatcaaaggcggaggcggaagtggaggcggaggatctggcggcggaggctctgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggcggtgtactactgcgcaagagccgagatgggagccgtattcgacatatggggtcagggtacaatggtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1153 - DNA, 1110 bp, Artificial Sequence
  Synthetic Polynucleotide
atggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagacacgtctggcctcctacttttggcggagggaccaaggttgagatcaaacggggcggaggcggaagtggaggcggaggatctggcggcggaggctctcagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagaggcaggggatatgcaaccagcttagccttcgatatctggggtcagggtacaatggtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1154 - DNA, 1125 bp, Artificial Sequence
  Synthetic Polynucleotide
atggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagggactcggcctccctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgccagagacggtacttatctaggtggtctctggtacttcgacttatgggggagaggtaccttggtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1155 - DNA, 1140 bp, Artificial Sequence
  Synthetic Polynucleotide
atggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgcccacactcctttcacttttggcggagggaccaaggttgagatcaaacggggcggaggcggaagtggaggcggaggatctggcggcggaggctctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagaactcctgaatactcctccagcatatggcactattactacggcatggacgtatggggccagggaacaactgtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1156 - DNA, 1113 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatagcgcatccaccagggccactggtatcccagccaggttcagtggcagtgggtctgggacagagttcactctcaccatcagcagcctgcagtctgaagattttgcagtttattactgtcagcagcaccacgtctggcctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgtcaaggggccgttgcaggagccgccatacgattatggaatggacgtatggggccagggaacaactgtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1157 - DNA, 1101 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattctactacccttggacttttggcggagggaccaaggttgagatcaaacggggcggaggcggaagtggaggcggaggatctggcggcggaggctctgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcaaccattagtagtagtagtagtaccatatactacgcagactctgtgaagggccgattcaccatctccagagacaatgccaagaactcactgtatctgcaaatgaacagcctgagagctgaggacacggcggtgtactactgcgccagaggttctcaggagcacctgattttcgattattggggacagggtacattggtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1158 - DNA, 1116 bp, Artificial Sequence
  Synthetic Polynucleotide
atggacatccagatgacacagagccctagcagcctgtctgccagcgtgggagacagagtgaccatcacctgtaccgccagcagcagagtgtccagcagctacctgcactggttccagcagaagcctggcaaggcccctaagctgctgatctacagcaccagcaatctggcctctggcgtgcccagcagattttctggctctggcagcggcaccgacttcaccctgacaatatctagcctccagcctgaggacttcgccacctactactgccaccagtaccacagaagcccctacacattcggccagggcaccaaggtggaaatcaagagaggcggaggcggaagtggaggcggaggatctggcggcggaggctctgaagttcagctggttgaatctggcggcggactggttcaacctggcggatctctgagactgagctgtgccgcctctggctacgccttcagcaacagctggatcaactgggtccgacaggcccctggcaaaggactggaatgggtcggacaaatctaccccggcgactacgacaccaactacaacggcaagttcaagggcagattcaccatcagccgggacaagagcaagaacaccgcctacctccagatgaactccctgagagccgaggacaccgccgtgtactattgtgctagaggcggctccatctactacggcaacctgggcttcttcgacgtgtggggacagggcacactggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1159 - DNA, 1086 bp, Artificial Sequence
  Synthetic Polynucleotide
atggacatccagatgacacagagccctagcagcctgtctgccagcgtgggagacagagtgaccatcacatgtagcgccagcagcagcgtgacctacatgtactggtatcagcagaagcccggcaaggcccctaagctgctgatctacgacaccagcaatctggcctctggcgtgcccagcagattttctggctctggcagcggcaccgactacaccctgacaatatctagcctccagcctgaggacttcgccacctactactgccagcagtggtccaactatcccctgacattcggccagggcaccaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacagcttcatcgagtacaccatcaactgggtccgacaggcccctggacaaggcctggaatggatcggcaacatcgacccctactacggcacaacctactacaaccagatgttcaccggcagagccacactgaccgtggacacctctatcagcaccgcctacatggaactgagccggctgagatccgatgacaccgccgtgtactattgtgccagaggcagcgcctggtttccctattggggacagggaaccctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1160 - DNA, 1086 bp, Artificial Sequence
  Synthetic Polynucleotide
atggagatcgtgctgacacagagcccttctagcctgtctgccagcgtgggcgacagagtgaccatcacatgtagagccagcgagaacatctacagctacctggcctggtatcagcagaagcctggcaaggcccctaagctgctgatctacaacaccaagacactcggcgagggcgtgcccagcagattttctggttctggcagcggcaccgacttcaccctgaccatatctagcctgcagcctgaggacttcgccacctactactgccagcaccactacggcacccctttcacatttggccctggcaccaaggtggacatcaaaggcggaggcggaagtggaggcggaggatctggcggcggaggctctcaagttcagctggttcagagcggagccgaagtgaagaaacctggggcctctgtgaaggtgtcctgcaaggccagcggctacaccttcagcgactattgggtgcactgggtccgacaggctccaggacaaggactggaatggatgggagccatcgacggcagcgataccttcaacgattacagccagaaattcaaaggccgcgtgaccatgaccagagacaccagcatcagcaccgcctacatggaactgagccggctgagatccgatgacaccgccgtgtactattgtgccagaggcggcctgctgcagtattggggacagggaacactggtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1161 - DNA, 1098 bp, Artificial Sequence
  Synthetic Polynucleotide
atggagatcgtgctgacacagtctcccgccacactgtcactgtctccaggcgaaagagccacactgagctgtagcgccagcagcagcgtgtcctacatgcactggtatcagcagaagcccggacaggcccctagactgctgatctacgataccagcaagctggcctctgacatccccgccagattttctggcagcggctctggcaccgatttcaccctgaccataagcagcctggaacctgaggacttcgccgtgtactactgtcagcagggcagcgtgtaccccttcacatttggcggcggaacaaaggtggaaatcaaaggcggaggcggaagtggaggcggaggatctggcggcggaggctctcaagttcagctgcaagagtctggccctggcctggttaagcctagcggaacactgagcctgacctgtgctgtgtctggcggcagcatcagcacatctggcatgggcgttggctgggtccgacagcctcctggaaaaggcctggaatggatcggccacatttggtgggacgacgacaagcggtacaaccccgctctgaagtccagagtgaccatcagcgtggacaagagcaagaaccagttcagcctgcggctgagcagcgtgacagctgcagataccgccgtgtattattgcgcccggatggaactgtggtcctactacttcgactactggggcaagggcaccaccgtgactgtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1162 - DNA, 1110 bp, Artificial Sequence
  Synthetic Polynucleotide
atggacatccagatgacccagaccacaagcagcctgtctgccagcctgggcgacagagtgaccatctcttgtagagccagccaggacatcagcaactacctgaactggtatcagcagaaacccgacggcaccgtgaagctgctgatctactacaccagcatcctgcacagcggcgtgcccagcagattttctggctctggcagcggcaccgactacagcctgaccatcagcaatctggaacaagaggacttcgctacctacttctgccagcaaggcaacaccctgccttggacatttggcggaggcaccaagctggaaatcaaagctggcggaggcggaagtggaggcggaggatctggcggcggaggctctgaagtgcaactggttgaatctggcggcggactggttaagcctggcggatctctgaagctgagctgtgccgcctctggcttcgccttcagcatctacgatatgagctgggtccgacagacccctgagaagagactggaatgggtcgcctacatctctagcggcggagggacctactatcccgacacagtgaagggcagattcaccatctccagagacaacgccaagaacaccctgtacctccagatgagcagcctgaagtccgaggacaccgccatgtactactgcgccagacacagcggctatggcacacattggggagtgctgtttgcctactggggccagggaacactggtcacagtttctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1163 - DNA, 1110 bp, Artificial Sequence
  Synthetic Polynucleotide
atggatattcaactgacacaatcccccagctcactcagcgccagcgtgggggacagggttagctttacctgtcaagcctctcaggatataaataactttctgaactggtatcaacagaagcctgggaaggcgcccaaactcctgatctatgatgcgtccaacctggaaactggcgtgccttcacgctttagcggctctggcagtggtacagacttcacttttaccatctcttcacttcagccggaggacatcgccacatattactgtcaacagtacggaaacttgccctttacttttggaggcggcaccaaagttgaaatcaaaagaggcggaggcggaagtggaggcggaggatctggcggcggaggctctcaggtccaactgcaagaaagcggacccggactggtgaagccttctgagacacttagtctgacgtgcacggtcagtggcggctccatctcctcctattattggtcatggatacgacaacccccaggtaagggcctggaatggattggctatatctactattcaggaagcacgaactacaatcccagcctgaagtcccgagtgacaatttcagtagataccagtaaaaaccagttcagtcttaaactgtcaagcgtgacagctgccgacaccgctgtgtattactgcgtctcactggtgtattgtggaggggattgttatagcgggttcgattattggggacagggaaccctggtgactgtatcttccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1164 - DNA, 1116 bp, Artificial Sequence
  Synthetic Polynucleotide
atggatatccagctcactcaaagcccctctagtctctctgcctcagtgggggatcgggtcagttttacttgtcaagcttcacaggatatcaacaacttccttaattggtatcagcagaagccaggaaaagcacccaagctgctcatctatgatgcctcaaatttggagacgggtgttcccagtcgattctctgggtcagggtccgggaccgactttacgtttacgatctcctctctgcagcccgaagacatcgccacatactattgtcaacagtacggcaacttgcctttcacatttgggggcgggactaaggttgaaatcaagaggggcggaggcggaagtggaggcggaggatctggcggcggaggctctcaggtacagctgcaggaatctgggcccggacttgtcaagccaagtcagacactttctcttacatgtaccgtgagcggcggaagtataagcagtggaggcttttactggtcttggatacggcagcacccaggcaaaggcttggagtggattggatacattcatcattcaggatctacacactataatccatcccttaagtcccgggtcaccattagcattgatacgtctaagaatctgttcagtctcaggctgtcctccgtcactgctgccgacacagccgtgtactactgcgcctccttggtttactgcggaggcgactgttatagcggctttgattattgggggcaggggaccctcgtaaccgtgagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1165 - DNA, 1116 bp, Artificial Sequence
  Synthetic Polynucleotide
atggacttcgtgatgacacagagccctctgagcctgcctgtgacacctggcgaacctgccagcatcagctgtagaagcagccagagcatcgtgcacagcaacggcaacacctacctggaatggtatctccagaagcctggacagagcccacagctgctgatctacaaggtgtccaacagattcagcggcgtgcccgacagattttctggcagcggctctggcaccgacttcaccctgaagattagcagagtggaagccgaggacgtgggcgtgtactactgcttccaaggctctcacgtgcccctgacctttggacagggcaccaagctggaaatcaagagaggcggaggcggaagtggaggcggaggatctggcggcggaggctctgaagtgcagctggttgaaagcggagccgaagtgaagaaacctggggcctctgtgaaggtgtcctgcaaggccagcggctacacctttaccagctactggattcactgggtccgacaggcccctggacaaggacttgagtggatgggcgagaacgacccctccaacggcaggaccaactacaacgagaagttcaagaaccgcgtgaccctgaccgtggacaccagcatctctaccgcctacatggaactgagccggctgagatccgatgacaccgccgtgtactattgcgccagaggacccaactacttttacagcatggactactggggccagggcacaatggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1166 - DNA, 1107 bp, Artificial Sequence
  Synthetic Polynucleotide
atggagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggcggaggcggaagtggaggcggaggatctggcggcggaggctctcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1167 - DNA, 1107 bp, Artificial Sequence
  Synthetic Polynucleotide
atgcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggcggaggcggaagtggaggcggaggatctggcggcggaggctctgagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1168 - DNA, 1125 bp, Artificial Sequence
  Synthetic Polynucleotide
atggacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggcggaggcggaagtggaggcggaggatctggcggcggaggctctcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1169 - DNA, 1125 bp, Artificial Sequence
  Synthetic Polynucleotide
atgcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggcggaggcggaagtggaggcggaggatctggcggcggaggctctgacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1170 - DNA, 1095 bp, Artificial Sequence
  Synthetic Polynucleotide
atggacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggcggaggcggaagtggaggcggaggatctggcggcggaggctctcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1171 - DNA, 1095 bp, Artificial Sequence
  Synthetic Polynucleotide
atgcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggcggaggcggaagtggaggcggaggatctggcggcggaggctctgacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1172 - DNA, 1072 bp, Artificial Sequence
  Synthetic Polynucleotide
atggagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1173 - DNA, 1072 bp, Artificial Sequence; identical to SEQ ID NO: 1172
  Synthetic Polynucleotide

SEQ ID NO: 1174 - DNA, 1084 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1175 - DNA, 1084 bp, Artificial Sequence; identical to SEQ ID NO: 1174
  Synthetic Polynucleotide

SEQ ID NO: 1176 - DNA, 1110 bp, Artificial Sequence
  Synthetic Polynucleotide
atggacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggcggaggcggaagtggaggcggaggatctggcggcggaggctctcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1177 - DNA, 1110 bp, Artificial Sequence
  Synthetic Polynucleotide
atgcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggcggaggcggaagtggaggcggaggatctggcggcggaggctctgacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1178 - DNA, 1119 bp, Artificial Sequence
  Synthetic Polynucleotide
atgcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggcggaggcggaagtggaggcggaggatctggcggcggaggctctcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1179 - DNA, 1119 bp, Artificial Sequence
  Synthetic Polynucleotide
atgcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggcggaggcggaagtggaggcggaggatctggcggcggaggctctcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1180 - DNA, 1095 bp, Artificial Sequence
  Synthetic Polynucleotide
atggacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggcggaggcggaagtggaggcggaggatctggcggcggaggctctcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1181 - DNA, 1095 bp, Artificial Sequence
  Synthetic Polynucleotide
atgcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggcggaggcggaagtggaggcggaggatctggcggcggaggctctgacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1182 - DNA, 1119 bp, Artificial Sequence
  Synthetic Polynucleotide
atggacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggcggaggcggaagtggaggcggaggatctggcggcggaggctctcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1183 - DNA, 1119 bp, Artificial Sequence
  Synthetic Polynucleotide
atgcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggcggaggcggaagtggaggcggaggatctggcggcggaggctctgacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1184 - DNA, 1104 bp, Artificial Sequence
  Synthetic Polynucleotide
atggacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggcggaggcggaagtggaggcggaggatctggcggcggaggctctgaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1185 - DNA, 1104 bp, Artificial Sequence
  Synthetic Polynucleotide
atggaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggcggaggcggaagtggaggcggaggatctggcggcggaggctctgacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1186 - DNA, 1095 bp, Artificial Sequence
  Synthetic Polynucleotide
atggacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1187 - DNA, 1095 bp, Artificial Sequence
  Synthetic Polynucleotide
atggaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggcggaggcggaagtggaggcggaggatctggcggcggaggctctgacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1188 - DNA, 1095 bp, Artificial Sequence
  Synthetic Polynucleotide
atggacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggcggaggcggaagtggaggcggaggatctggcggcggaggctctgaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1189 - DNA, 1095 bp, Artificial Sequence
  Synthetic Polynucleotide
atggaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggcggaggcggaagtggaggcggaggatctggcggcggaggctctgacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1190 - DNA, 1119 bp, Artificial Sequence
  Synthetic Polynucleotide
atgcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggcggaggcggaagtggaggcggaggatctggcggcggaggctctcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1191 - DNA, 1119 bp, Artificial Sequence
  Synthetic Polynucleotide
atgcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggcggaggcggaagtggaggcggaggatctggcggcggaggctctcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1192 - DNA, 1140 bp, Artificial Sequence
  Synthetic Polynucleotide
atggacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggcggaggcggaagtggaggcggaggatctggcggcggaggctctgaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1193 - DNA, 1140 bp, Artificial Sequence
  Synthetic Polynucleotide
atggaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggcggaggcggaagtggaggcggaggatctggcggcggaggctctgacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctggagcagaaactgatctcggaagaggatctgtga

SEQ ID NO: 1194 - DNA, 1056 bp, Artificial Sequence
  Synthetic Polynucleotide
atggtcgtgatgacccagacccctctgagcctgagcgtgacactgggacagcctgccagcatcagctgcaagagcagccagagcctgctgcacagcgacggcaagacctacctgaactggctgcagcagaggccaggccagagccctcggagactgatctacctggtgtccaagctggacagcggcgtgcccgatagattttccggctctggcagcggcaccgacttcaccctgaagatcagccgggtggaagccgaggacgtgggcatctactactgttggcagggcacccacctgtggacctttggcggcggaacaaaggtggaaatcaagggcggaggcggaagtggaggcggaggatctggcggcggaggctctgaagtgcacctggtggaaagcggcggaggactggtgcagccagggggatctctgagactgtcttgtgccgccagcggcttcaccttcagcagatacggcatgagctgggtgcgccaggcccctggaaaaggactggaactggtggctatgatgaagaccaagggcggcagaacctactaccccgacagcgtgaagggccggttcaccatctcccgggacaacgccaagaacagcctgtacctgcagatgaactccctgcgggccgaggacaccgccatctactattgtgcctccgacggctactactggggccagggaacaaccgtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1195 - DNA, 1065 bp, Artificial Sequence
  Synthetic Polynucleotide
atggagatcgtgctgacacagtctcccgccacactgtcactgtctccaggcgaaagagccacactgagctgtagcgccaccagcagcgtgtcctacatgcactggtatcagcagaagcccggcaaggcccctaagcggtggatctacgataccagcaaactggcctctggcgtgcccagcagattttctggctctggcagcggcaccgagttcaccctgacaatatctagcctccagcctgaggacttcgccacctactactgccagcagtggtccagcaatcccctgacctttggacagggcaccaagctggaaatcaaaggcggaggcggaagtggaggcggaggatctggcggcggaggctctcaagttcagctggttcagtctggggccgaagtgaagaaacctggggcctctgtgaaggtgtcctgcaaggccagcggctacaagttcaccagctacgtgatgcactgggtccgacaggctccaggacaaggactggaatggatcggctacatcaacccctacaacgacgtgaccaagtacaacgagaagttcaagggcagagtgaccatcaccgccgacaagagcacaagcaccgcctacatggaactgagcagcctgagaagcgaggacaccgccgtgcactattgtgccagaggcagctactacgactacgacggctttgtgtattggggccagggcaccctggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1196 - DNA, 1080 bp, Artificial Sequence
  Synthetic Polynucleotide
atggacatcgtgatgacacagagccctgatagcctggccgtgtctctgggagagagagccaccatcaactgcaagagcagccagagcctgctgaacagccggaccagaaagaactacctggcctggtatcagcagaagcccggacagtctcccaagctgctgatctactggaccagcaccagaaagtccggcgtgcccgatagattttctggctctggcagcggcaccgacttcaccctgacaatttctagcctgcaagccgaggacgtggccgtgtactactgcaagcagagcttcatcctgcggacctttggccagggcaccaaggtggaaatcaaaggcggaggcggaagtggaggcggaggatctggcggcggaggctctgaagttcagctggttcagagcggagccgaagtgaagaaacctggggcctctgtgaaggtgtcctgcaaggcttccggcttcaccttcaccagctactacatccactgggtccgacaggcccctggacaaggactggaatggatcggctggatctaccccgagaacgacaacaccaagtacaacgagaagttcaaggaccgcgtgaccatcaccgccgataccagcacaagcaccgcctacctggaactgagcagcctgagaagcgaggacaccgccgtgtattattgcgccagagatgcctacagccggtactacttcgactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1197 - DNA, 1089 bp, Artificial Sequence
  Synthetic Polynucleotide
atggacatcgtgatgacacagagccctctgagcctgcctgtgacacctggcgaacctgccagcatcagctgtagaagcagccagagactgctgagcagctacggccacacatacctgcactggtatctccagaagcctggacagagcccacagctgctgatctacgaggtgtccaacagattcagcggcgtgcccgatagattttccggctctggcagcggcaccgacttcaccctgaagattagcagagtggaagccgaggacgtgggcgtgtactactgtagccagagcacacacgtgcccctgacctttggacagggcaccaaggtggaaatcaaaggcggaggcggaagtggaggcggaggatctggcggcggaggctctgaagtgcagctggttgaatctggcggcggactggttaagcctggcggatctctgagactgagctgtgccgccagcggctacaccttcagcaattactggatcggctgggtccgacaggcccctggaaaaggactggaatggatcggcgacatctaccctggcggcaactacatcagaaacaacgagaagttcaaggacaagaccacactgagcgccgacaccagcaagaacacagcctacctccagatgaacagcctgaaaaccgaggacaccgccgtgtactattgcggcagcagcttcggcagcaactacgtgttcgcctggttcacctattggggccagggcacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1198 - DNA, 1083 bp, Artificial Sequence
  Synthetic Polynucleotide
atggacatcgtgatgtctcagagccctagcagcctggctgtgtccgctggcgagaaagtgaccatgagctgcaagagcagccagagcctgttcaacagccggaccagaaagaactacctggcctggtatcagcagaagcccggacagtctcccaagctgctgatctactgggccagcgccagagatagcggagtgcctgctagattcacaggcagcggcagcgagacatacttcaccctgaccatcagcagagtgcaggccgaggatctggccgtgtactactgtatgcagagcttcaacctgcggaccttcggcggaggcaccaagctggaaatcaaaggcggaggcggaagtggaggcggaggatctggcggcggaggctctgaagtgaacctggttgaatccggcggaggactggttcagcctggcggatctctgagactgagctgtgccaccagcggcttcaccttcaccgacaactacatgagctgggtccgacagcctcctggcaaagctctggaatggctgggcttcatcagaaacaaggccaacggctacaccaccgactacagcgcctctgtgcggggcagattcaccatctccagagacaacagccagtccatcctgtacctccagatgaacgccctgagagccgaggatagcgccacctactactgtgccagagatgtgggcagcaactacttcgactattggggccagggcaccacactgaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1199 - DNA, 1086 bp, Artificial Sequence
  Synthetic Polynucleotide
atggacatcgtgatgacacagagccctgatagcctggccgtgtctctcggcgagcgcgtgacaatgaattgcaagagcagccagagcctgctgtactccaccaaccagaagaactacctggcctggtatcagcagaagcccggacagtctcccaagctgctgatctactgggccagcaccagagaaagcggcgtgcccgatagattttctggctctggcagcggcaccgacttcaccctgacaatcagttctgtgcaggccgaggacgtggccgtgtactactgccagcagtattacagctaccggaccttcggcggaggcaccaagctggaaatcaaaggcggaggcggaagtggaggcggaggatctggcggcggaggctctcaagttcagctccagcagtctggccccgagtggaaacctggcgcttctgtgaagatgagctgcaaggccagcggctacaccttcaccagctacgtgatccactgggtccgacagaagcctggccaaggactggattggatcggctacatcaacccctacaacgacggcaccgattacgacgagaagttcaagggcaaagccacactgaccagcgacaccagcacaagcaccgcctacatggaactgagcagcctgagaagcgaggacaccgccgtgtattattgcgccagagagaaggacaactacgccaccggcgcttggtttgcctattggggccagggaacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1200 - DNA, 1074 bp, Artificial Sequence
  Synthetic Polynucleotide
atggacatccagatgacacagagccctagcagcctgtctgccagcgtgggagacagagtgaccatcacctgtagagccagccaggacatcagaaactacctgaactggtatcagcagaagcccggcaaggcccctaagctgctgatctactacaccagcagactggaaagcggcgtgcccagcagattttctggcagcggctctggcaccgactacaccctgacaatatccagcctccagcctgaggacttcgccacctactattgccagcagggcaacaccctgccttggacatttggccagggcaccaaggtggaaatcaaaggcggaggcggaagtggaggcggaggatctggcggcggaggctctgaagtgcagctggttgaatcaggtggcggcctggttcaacctggcggatctctgagactgagctgtgccgccagcggctacagctttaccggctacaccatgaactgggtccgacaggcccctggcaaaggactggaatgggtcgccctgattaacccctacaagggcgtgtccacctacaaccagaagttcaaggacaggttcaccatcagcgtggacaagagcaagaacaccgcctacctccagatgaactccctgagagccgaggacaccgccgtgtactattgtgccagaagcggctactacggcgacagcgactggtactttgatgtgtggggccagggaaccctggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1201 - DNA, 1080 bp, Artificial Sequence
  Synthetic Polynucleotide
atgagcacaggatctcaggtgcagctccagcagtctggccctgagcttgtgaaacctggcgcttccgtgaagatgagctgcaaggccagcggctacaccttcaccgactatgtgattaactggggcaagcagcggagcggccaaggactggaatggatcggcgaaatctaccctggcagcggcaccaactactacaacgagaagttcaaggccaaggccacactgaccgccgacaagagcagcaatatcgcctacatgcagctgagcagcctgaccagcgaagatagcgccgtgtacttctgcgccagaagaggcagatacggcctgtacgctatggactattggggccagggcaccagcgtgacagtgtcatctggcggaggcggaagtggaggcggaggatctggcggcggaggctctgacatccagatgacccagacaaccagcagcctgtctgccagcctgggcgatagagtgaccatcagctgtagagccagccaggacatcagcaactacctgaactggtatcagcagaaacccgacggcaccgtgaagctgctgatctactacaccagcagactgcacagcggcgtgcccagcagattttctggctctggaagcggcacagattactccctgaccatcaacaacctggaacaagaggacattgccacctacttttgccagcaaggcaacacccggccttggacatttggcggaggcaccaagctggaaatcaagggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1202 - DNA, 1065 bp, Artificial Sequence
  Synthetic Polynucleotide
atgcagatcgtgctgacacagagccctgccatcatgagcgcttccccaggcgagaaagtgaccatgacctgtagcgccacaagcagcgtgtcctacatgcactggtatcagcagaagtccggcacaagccccaagcggtggatctacgataccagcaaactggcctctggcgtgcccgctagattttctggctctggcagcggcaccagctacagcctgacaatcagcagcatggaagccgaggatgccgccacctactactgccagcagtggtccagcaatcccctgacatttggagccggcaccaagctggaactgaaaggcggaggcggaagtggaggcggaggatctggcggcggaggctctgaagttcagctccagcagtctggccccgagcttgtgaaacctggcgcttccgtgaagatgagctgcaaggccagcggctacaagttcacctcctacgtgatgcactgggtcaagcagaaacccggccagggccttgagtggatcggctacatcaacccctacaacgacgtgaccaagtacaacgagaagttcaagggcaaagccacactgaccagcgacaagagcagcagcaccgcctacatggaactgagcagcctgacctctgaggacagcgccgtgcactattgtgccagaggcagctactacgactacgacggctttgtgtattggggccagggcaccctggttaccgtttctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1203 - DNA, 1068 bp, Artificial Sequence
  Synthetic Polynucleotide
atggacatccagatgacacagagccctgccagccagtctgcctctctgggagagtctgtgaccatcacctgtctggcctctcagaccatcggaacatggctggcctggtatcagcagaagcctggcaagtctccccagctgctgatctacgccgctacatctctggctgatggcgtgcccagcagattttctggcagcggctccggcaccaagttcagcctgaagatcagaaccctccaggccgaggacttcgtgtcctactattgccagcagctgtactccaagccttacacctttggcggaggcaccaagctggaaatcaagagaggcggaggcggaagtggaggcggaggatctggcggcggaggctctgaagttcagctgcaacagagcggagccgagctggttaagcctggcgcttctgtgaagctgagctgtacccctagcggcttcaacgtgaaggacacctacatccactgggtcaagcagcggcctaagcagggcctcgaatggatcggaagaatcgaccctagcgacggcgacattaagtacgaccccaagttccagggcaaagccaccatcaccgccgacaccagcagcaacacagtgtctctccagctgagcagcctgaccagcgaagataccgccgtgtactattgcgcccgttggttcggcgattacggggccatgaattattggggccagggcaccagcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaaaaggatgagctg

SEQ ID NO: 1204 - skipped

SEQ ID NO: 1205 - DNA, 1068 bp, Artificial Sequence
  Synthetic Polynucleotide
atggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1206 - DNA, 1068 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1207 - DNA, 1068 bp, Artificial Sequence
  Synthetic Polynucleotide
atggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1208 - DNA, 1071 bp, Artificial Sequence
  Synthetic Polynucleotide
atggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1209 - DNA, 1092 bp, Artificial Sequence
  Synthetic Polynucleotide
atggacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1210 - DNA, 1143 bp, Artificial Sequence
  Synthetic Polynucleotide
atgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1211 - DNA, 1074 bp, Artificial Sequence
  Synthetic Polynucleotide
atggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1212 - DNA, 1071 bp, Artificial Sequence
  Synthetic Polynucleotide
atgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1213 - DNA, 1089 bp, Artificial Sequence
  Synthetic Polynucleotide
atgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1214 - DNA, 1104 bp, Artificial Sequence
  Synthetic Polynucleotide
atgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1215 - DNA, 1065 bp, Artificial Sequence
  Synthetic Polynucleotide
atggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1216 - DNA, 1095 bp, Artificial Sequence
  Synthetic Polynucleotide
atggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1217 - DNA, 1068 bp, Artificial Sequence
  Synthetic Polynucleotide
atggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1218 - DNA, 1080 bp, Artificial Sequence
  Synthetic Polynucleotide
atggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1219 - DNA, 1074 bp, Artificial Sequence
  Synthetic Polynucleotide
atggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1220 - DNA, 1074 bp, Artificial Sequence
  Synthetic Polynucleotide
atggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1221 - DNA, 1077 bp, Artificial Sequence
  Synthetic Polynucleotide
atgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1222 - DNA, 1071 bp, Artificial Sequence
  Synthetic Polynucleotide
atgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1223 - DNA, 1104 bp, Artificial Sequence
  Synthetic Polynucleotide
atgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1224 - DNA, 1071 bp, Artificial Sequence
  Synthetic Polynucleotide
atggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1225 - DNA, 1074 bp, Artificial Sequence
  Synthetic Polynucleotide
atggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1226 - DNA, 1077 bp, Artificial Sequence
  Synthetic Polynucleotide
atggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1227 - DNA, 1077 bp, Artificial Sequence
  Synthetic Polynucleotide
atggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1228 - DNA, 1077 bp, Artificial Sequence; identical to SEQ ID NO: 1227
  Synthetic Polynucleotide

SEQ ID NO: 1229 - DNA, 1077 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1230 - DNA, 1083 bp, Artificial Sequence
  Synthetic Polynucleotide
atggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1231 - DNA, 1074 bp, Artificial Sequence
  Synthetic Polynucleotide
atggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1232 - DNA, 1083 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1233 - DNA, 1077 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1234 - DNA, 1074 bp, Artificial Sequence
  Synthetic Polynucleotide
atggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1235 - DNA, 1104 bp, Artificial Sequence
  Synthetic Polynucleotide
atgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1236 - DNA, 1080 bp, Artificial Sequence
  Synthetic Polynucleotide
atgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1237 - DNA, 1074 bp, Artificial Sequence; identical to SEQ ID NO: 1234
  Synthetic Polynucleotide

SEQ ID NO: 1238 - DNA, 1071 bp, Artificial Sequence
  Synthetic Polynucleotide
atggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1239 - DNA, 1077 bp, Artificial Sequence
  Synthetic Polynucleotide
atggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1240 - DNA, 1071 bp, Artificial Sequence
  Synthetic Polynucleotide
atggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1241 - DNA, 1086 bp, Artificial Sequence
  Synthetic Polynucleotide
atggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1242 - DNA, 1062 bp, Artificial Sequence
  Synthetic Polynucleotide
atggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1243 - DNA, 1080 bp, Artificial Sequence
  Synthetic Polynucleotide
atggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1244 - DNA, 1080 bp, Artificial Sequence
  Synthetic Polynucleotide
atgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1245 - DNA, 1059 bp, Artificial Sequence
  Synthetic Polynucleotide
atggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1246 - DNA, 1074 bp, Artificial Sequence
  Synthetic Polynucleotide
atggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1247 - DNA, 1065 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1248 - DNA, 1095 bp, Artificial Sequence
  Synthetic Polynucleotide
atggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1249 - DNA, 1083 bp, Artificial Sequence
  Synthetic Polynucleotide
atggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1250 - DNA, 1161 bp, Artificial Sequence
  Synthetic Polynucleotide
atgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1251 - DNA, 1158 bp, Artificial Sequence
  Synthetic Polynucleotide
atgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1252 - DNA, 1206 bp, Artificial Sequence
  Synthetic Polynucleotide
atggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1253 - DNA, 1074 bp, Artificial Sequence
  Synthetic Polynucleotide
atggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1254 - DNA, 1071 bp, Artificial Sequence
  Synthetic Polynucleotide
atggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1255 - DNA, 1062 bp, Artificial Sequence
  Synthetic Polynucleotide
atggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1256 - DNA, 1092 bp, Artificial Sequence
  Synthetic Polynucleotide
atggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1257 - DNA, 1053 bp, Artificial Sequence
  Synthetic Polynucleotide
atggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1258 - DNA, 1077 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1259 - DNA, 1065 bp, Artificial Sequence
  Synthetic Polynucleotide
atggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1260 - DNA, 1077 bp, Artificial Sequence
  Synthetic Polynucleotide
atggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1261 - DNA, 1065 bp, Artificial Sequence
  Synthetic Polynucleotide
atggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1262 - DNA, 1089 bp, Artificial Sequence
  Synthetic Polynucleotide
atggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1263 - DNA, 1074 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1264 - DNA, 1086 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1265 - DNA, 1086 bp, Artificial Sequence
  Synthetic Polynucleotide
atggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1266 - DNA, 1068 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1267 - DNA, 1074 bp, Artificial Sequence
  Synthetic Polynucleotide
atgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1268 - DNA, 1065 bp, Artificial Sequence
  Synthetic Polynucleotide
atggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1269 - DNA, 1068 bp, Artificial Sequence
  Synthetic Polynucleotide
atggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1270 - DNA, 1056 bp, Artificial Sequence
  Synthetic Polynucleotide
atggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1271 - DNA, 1149 bp, Artificial Sequence
  Synthetic Polynucleotide
atgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1272 - DNA, 1062 bp, Artificial Sequence
  Synthetic Polynucleotide
atggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1273 - DNA, 1089 bp, Artificial Sequence
  Synthetic Polynucleotide
atggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1274 - DNA, 1101 bp, Artificial Sequence
  Synthetic Polynucleotide
atggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1275 - DNA, 1074 bp, Artificial Sequence
  Synthetic Polynucleotide
atggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1276 - DNA, 1059 bp, Artificial Sequence
  Synthetic Polynucleotide
atggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1277 - DNA, 1068 bp, Artificial Sequence
  Synthetic Polynucleotide
atggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1278 - DNA, 1053 bp, Artificial Sequence
  Synthetic Polynucleotide
atgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1279 - DNA, 1083 bp, Artificial Sequence
  Synthetic Polynucleotide
atggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1280 - DNA, 1059 bp, Artificial Sequence
  Synthetic Polynucleotide
atggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1281 - DNA, 1068 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1282 - DNA, 1098 bp, Artificial Sequence
  Synthetic Polynucleotide
atggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1283 - DNA, 1089 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1284 - DNA, 1065 bp, Artificial Sequence
  Synthetic Polynucleotide
atggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1285 - DNA, 1044 bp, Artificial Sequence
  Synthetic Polynucleotide
atgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1286 - DNA, 1059 bp, Artificial Sequence
  Synthetic Polynucleotide
atgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1287 - DNA, 1068 bp, Artificial Sequence
  Synthetic Polynucleotide
atggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1288 - DNA, 1083 bp, Artificial Sequence
  Synthetic Polynucleotide
atggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1289 - DNA, 1068 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1290 - DNA, 1086 bp, Artificial Sequence
  Synthetic Polynucleotide
atggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1291 - DNA, 1080 bp, Artificial Sequence
  Synthetic Polynucleotide
atggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1292 - DNA, 1080 bp, Artificial Sequence
  Synthetic Polynucleotide
atggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1293 - DNA, 1074 bp, Artificial Sequence
  Synthetic Polynucleotide
atggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1294 - DNA, 1065 bp, Artificial Sequence
  Synthetic Polynucleotide
atggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1295 - DNA, 1068 bp, Artificial Sequence
  Synthetic Polynucleotide
atggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1296 - DNA, 1074 bp, Artificial Sequence
  Synthetic Polynucleotide
atggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1297 - DNA, 1077 bp, Artificial Sequence
  Synthetic Polynucleotide
atggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1298 - DNA, 1077 bp, Artificial Sequence
  Synthetic Polynucleotide
atggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1299 - DNA, 1077 bp, Artificial Sequence
  Synthetic Polynucleotide
atggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1300 - DNA, 1071 bp, Artificial Sequence
  Synthetic Polynucleotide
atggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1301 - DNA, 1071 bp, Artificial Sequence
  Synthetic Polynucleotide
atggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1302 - DNA, 1086 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1303 - DNA, 1086 bp, Artificial Sequence
  Synthetic Polynucleotide
atgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1304 - DNA, 1080 bp, Artificial Sequence
  Synthetic Polynucleotide
atggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1305 - DNA, 1065 bp, Artificial Sequence
  Synthetic Polynucleotide
atggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1306 - DNA, 1050 bp, Artificial Sequence
  Synthetic Polynucleotide
atggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1307 - DNA, 1068 bp, Artificial Sequence
  Synthetic Polynucleotide
atggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1308 - DNA, 1089 bp, Artificial Sequence
  Synthetic Polynucleotide
atggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1309 - DNA, 1092 bp, Artificial Sequence
  Synthetic Polynucleotide
atggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1310 - DNA, 1083 bp, Artificial Sequence
  Synthetic Polynucleotide
atggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1311 - DNA, 1074 bp, Artificial Sequence
  Synthetic Polynucleotide
atggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1312 - DNA, 1107 bp, Artificial Sequence
  Synthetic Polynucleotide
atggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1313 - DNA, 1095 bp, Artificial Sequence
  Synthetic Polynucleotide
atgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1314 - DNA, 1077 bp, Artificial Sequence
  Synthetic Polynucleotide
atggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1315 - DNA, 1068 bp, Artificial Sequence
  Synthetic Polynucleotide
atggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1316 - DNA, 1062 bp, Artificial Sequence
  Synthetic Polynucleotide
atggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1317 - DNA, 1068 bp, Artificial Sequence
  Synthetic Polynucleotide
atggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1318 - DNA, 1074 bp, Artificial Sequence
  Synthetic Polynucleotide
atgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1319 - DNA, 1089 bp, Artificial Sequence
  Synthetic Polynucleotide
atgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1320 - DNA, 1071 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1321 - DNA, 1074 bp, Artificial Sequence
  Synthetic Polynucleotide
atggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1322 - DNA, 1071 bp, Artificial Sequence
  Synthetic Polynucleotide
atgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1323 - DNA, 1068 bp, Artificial Sequence
  Synthetic Polynucleotide
atgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1324 - DNA, 1068 bp, Artificial Sequence
  Synthetic Polynucleotide
atgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1325 - DNA, 1074 bp, Artificial Sequence
  Synthetic Polynucleotide
atgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1326 - DNA, 1068 bp, Artificial Sequence
  Synthetic Polynucleotide
atggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1327 - DNA, 1065 bp, Artificial Sequence
  Synthetic Polynucleotide
atggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1328 - DNA, 1065 bp, Artificial Sequence
  Synthetic Polynucleotide
atggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1329 - DNA, 1089 bp, Artificial Sequence
  Synthetic Polynucleotide
atggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1330 - DNA, 1107 bp, Artificial Sequence
  Synthetic Polynucleotide
atgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1331 - DNA, 1062 bp, Artificial Sequence
  Synthetic Polynucleotide
atggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1332 - DNA, 1092 bp, Artificial Sequence
  Synthetic Polynucleotide
atggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1333 - DNA, 1080 bp, Artificial Sequence
  Synthetic Polynucleotide
atggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1334 - DNA, 1032 bp, Artificial Sequence
  Synthetic Polynucleotide
atggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1335 - DNA, 1062 bp, Artificial Sequence
  Synthetic Polynucleotide
atggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1336 - DNA, 1074 bp, Artificial Sequence
  Synthetic Polynucleotide
atggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1337 - DNA, 1062 bp, Artificial Sequence
  Synthetic Polynucleotide
atggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1338 - DNA, 1065 bp, Artificial Sequence
  Synthetic Polynucleotide
atggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1339 - DNA, 1080 bp, Artificial Sequence
  Synthetic Polynucleotide
atggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1340 - DNA, 1062 bp, Artificial Sequence
  Synthetic Polynucleotide
atggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1341 - DNA, 1065 bp, Artificial Sequence
  Synthetic Polynucleotide
atggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1342 - DNA, 1089 bp, Artificial Sequence
  Synthetic Polynucleotide
atggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1343 - DNA, 1077 bp, Artificial Sequence; identical to SEQ ID NO: 1260
  Synthetic Polynucleotide

SEQ ID NO: 1344 - DNA, 1068 bp, Artificial Sequence
  Synthetic Polynucleotide
atggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1345 - DNA, 1068 bp, Artificial Sequence
  Synthetic Polynucleotide
atggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1346 - DNA, 1065 bp, Artificial Sequence
  Synthetic Polynucleotide
atggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1347 - DNA, 1062 bp, Artificial Sequence
  Synthetic Polynucleotide
atggatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1348 - DNA, 1065 bp, Artificial Sequence
  Synthetic Polynucleotide
atggacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1349 - DNA, 1077 bp, Artificial Sequence
  Synthetic Polynucleotide
atggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1350 - DNA, 1086 bp, Artificial Sequence
  Synthetic Polynucleotide
atggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1351 - DNA, 1092 bp, Artificial Sequence
  Synthetic Polynucleotide
atggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1352 - DNA, 1089 bp, Artificial Sequence
  Synthetic Polynucleotide
atggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1353 - DNA, 1059 bp, Artificial Sequence
  Synthetic Polynucleotide
atggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1354 - DNA, 1065 bp, Artificial Sequence
  Synthetic Polynucleotide
atggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1355 - DNA, 1065 bp, Artificial Sequence
  Synthetic Polynucleotide
atggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1356 - DNA, 1068 bp, Artificial Sequence
  Synthetic Polynucleotide
atggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1357 - DNA, 1062 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1358 - DNA, 1119 bp, Artificial Sequence
  Synthetic Polynucleotide
atggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1359 - DNA, 1110 bp, Artificial Sequence
  Synthetic Polynucleotide
atggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1360 - DNA, 1032 bp, Artificial Sequence
  Synthetic Polynucleotide
atggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1361 - DNA, 1080 bp, Artificial Sequence
  Synthetic Polynucleotide
atggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1362 - DNA, 1053 bp, Artificial Sequence
  Synthetic Polynucleotide
atggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1363 - DNA, 1056 bp, Artificial Sequence
  Synthetic Polynucleotide
atggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1364 - DNA, 1056 bp, Artificial Sequence
  Synthetic Polynucleotide
atggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1365 - DNA, 1089 bp, Artificial Sequence
  Synthetic Polynucleotide
atggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1366 - DNA, 1077 bp, Artificial Sequence
  Synthetic Polynucleotide
atgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1367 - DNA, 1062 bp, Artificial Sequence
  Synthetic Polynucleotide
atggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1368 - DNA, 1074 bp, Artificial Sequence
  Synthetic Polynucleotide
atggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1369 - DNA, 1101 bp, Artificial Sequence
  Synthetic Polynucleotide
atggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1370 - DNA, 1074 bp, Artificial Sequence
  Synthetic Polynucleotide
atggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1371 - DNA, 1083 bp, Artificial Sequence
  Synthetic Polynucleotide
atggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1372 - DNA, 1068 bp, Artificial Sequence
  Synthetic Polynucleotide
atggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1373 - DNA, 1071 bp, Artificial Sequence
  Synthetic Polynucleotide
atggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1374 - DNA, 1062 bp, Artificial Sequence
  Synthetic Polynucleotide
atggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1375 - DNA, 1098 bp, Artificial Sequence
  Synthetic Polynucleotide
atggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1376 - DNA, 1068 bp, Artificial Sequence
  Synthetic Polynucleotide
atggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1377 - DNA, 1059 bp, Artificial Sequence
  Synthetic Polynucleotide
atggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1378 - DNA, 1074 bp, Artificial Sequence
  Synthetic Polynucleotide
atggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1379 - DNA, 1071 bp, Artificial Sequence
  Synthetic Polynucleotide
atggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1380 - DNA, 1077 bp, Artificial Sequence
  Synthetic Polynucleotide
atggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1381 - DNA, 1065 bp, Artificial Sequence
  Synthetic Polynucleotide
atgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1382 - DNA, 1059 bp, Artificial Sequence
  Synthetic Polynucleotide
atggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1383 - DNA, 1092 bp, Artificial Sequence
  Synthetic Polynucleotide
atggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1384 - DNA, 1077 bp, Artificial Sequence
  Synthetic Polynucleotide
atggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1385 - DNA, 1080 bp, Artificial Sequence
  Synthetic Polynucleotide
atggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1386 - DNA, 1080 bp, Artificial Sequence
  Synthetic Polynucleotide
atggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1387 - DNA, 1080 bp, Artificial Sequence
  Synthetic Polynucleotide
atgcaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1388 - DNA, 1062 bp, Artificial Sequence
  Synthetic Polynucleotide
atggacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1389 - DNA, 1068 bp, Artificial Sequence
  Synthetic Polynucleotide
atggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1390 - DNA, 1065 bp, Artificial Sequence
  Synthetic Polynucleotide
atggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1391 - DNA, 1071 bp, Artificial Sequence
  Synthetic Polynucleotide
atggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1392 - DNA, 1044 bp, Artificial Sequence
  Synthetic Polynucleotide
atggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1393 - DNA, 1053 bp, Artificial Sequence
  Synthetic Polynucleotide
atggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1394 - DNA, 1074 bp, Artificial Sequence
  Synthetic Polynucleotide
atggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1395 - DNA, 1062 bp, Artificial Sequence
  Synthetic Polynucleotide
atggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1396 - DNA, 1065 bp, Artificial Sequence
  Synthetic Polynucleotide
atggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1397 - DNA, 1068 bp, Artificial Sequence
  Synthetic Polynucleotide
atggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1398 - DNA, 1083 bp, Artificial Sequence
  Synthetic Polynucleotide
atggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1399 - DNA, 1107 bp, Artificial Sequence
  Synthetic Polynucleotide
atggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1400 - DNA, 1089 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacgccgcctaccctacttttggcggagggaccaaggttgagatcaaacggggcggaggcggaagtggaggcggaggatctggcggcggaggctctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggcggtgtactactgcgccagagagagttggccaatggacgtatggggccagggaacaactgtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1401 - DNA, 1104 bp, Artificial Sequence
  Synthetic Polynucleotide
atggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaaaggcggaggcggaagtggaggcggaggatctggcggcggaggctctcaaatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1402 - DNA, 1095 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagaatctcctggcctttcacttttggcggagggaccaaggttgagatcaaaggcggaggcggaagtggaggcggaggatctggcggcggaggctctgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggcggtgtactactgcgcaagagccgagatgggagccgtattcgacatatggggtcagggtacaatggtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1403 - DNA, 1110 bp, Artificial Sequence
  Synthetic Polynucleotide
atggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagacacgtctggcctcctacttttggcggagggaccaaggttgagatcaaacggggcggaggcggaagtggaggcggaggatctggcggcggaggctctcagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagaggcaggggatatgcaaccagcttagccttcgatatctggggtcagggtacaatggtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1404 - DNA, 1125 bp, Artificial Sequence
  Synthetic Polynucleotide
atggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagggactcggcctccctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgccagagacggtacttatctaggtggtctctggtacttcgacttatgggggagaggtaccttggtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1405 - DNA, 1140 bp, Artificial Sequence
  Synthetic Polynucleotide
atggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgcccacactcctttcacttttggcggagggaccaaggttgagatcaaacggggcggaggcggaagtggaggcggaggatctggcggcggaggctctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagaactcctgaatactcctccagcatatggcactattactacggcatggacgtatggggccagggaacaactgtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1406 - DNA, 1113 bp, Artificial Sequence
  Synthetic Polynucleotide
atggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatagcgcatccaccagggccactggtatcccagccaggttcagtggcagtgggtctgggacagagttcactctcaccatcagcagcctgcagtctgaagattttgcagtttattactgtcagcagcaccacgtctggcctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgtcaaggggccgttgcaggagccgccatacgattatggaatggacgtatggggccagggaacaactgtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1407 - DNA, 1101 bp, Artificial Sequence
  Synthetic Polynucleotide
atggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattctactacccttggacttttggcggagggaccaaggttgagatcaaacggggcggaggcggaagtggaggcggaggatctggcggcggaggctctgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcaaccattagtagtagtagtagtaccatatactacgcagactctgtgaagggccgattcaccatctccagagacaatgccaagaactcactgtatctgcaaatgaacagcctgagagctgaggacacggcggtgtactactgcgccagaggttctcaggagcacctgattttcgattattggggacagggtacattggtcaccgtctcctcaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1408 - DNA, 1116 bp, Artificial Sequence
  Synthetic Polynucleotide
atggacatccagatgacacagagccctagcagcctgtctgccagcgtgggagacagagtgaccatcacctgtaccgccagcagcagagtgtccagcagctacctgcactggttccagcagaagcctggcaaggcccctaagctgctgatctacagcaccagcaatctggcctctggcgtgcccagcagattttctggctctggcagcggcaccgacttcaccctgacaatatctagcctccagcctgaggacttcgccacctactactgccaccagtaccacagaagcccctacacattcggccagggcaccaaggtggaaatcaagagaggcggaggcggaagtggaggcggaggatctggcggcggaggctctgaagttcagctggttgaatctggcggcggactggttcaacctggcggatctctgagactgagctgtgccgcctctggctacgccttcagcaacagctggatcaactgggtccgacaggcccctggcaaaggactggaatgggtcggacaaatctaccccggcgactacgacaccaactacaacggcaagttcaagggcagattcaccatcagccgggacaagagcaagaacaccgcctacctccagatgaactccctgagagccgaggacaccgccgtgtactattgtgctagaggcggctccatctactacggcaacctgggcttcttcgacgtgtggggacagggcacactggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1409 - DNA, 1086 bp, Artificial Sequence
  Synthetic Polynucleotide
atggacatccagatgacacagagccctagcagcctgtctgccagcgtgggagacagagtgaccatcacatgtagcgccagcagcagcgtgacctacatgtactggtatcagcagaagcccggcaaggcccctaagctgctgatctacgacaccagcaatctggcctctggcgtgcccagcagattttctggctctggcagcggcaccgactacaccctgacaatatctagcctccagcctgaggacttcgccacctactactgccagcagtggtccaactatcccctgacattcggccagggcaccaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacagcttcatcgagtacaccatcaactgggtccgacaggcccctggacaaggcctggaatggatcggcaacatcgacccctactacggcacaacctactacaaccagatgttcaccggcagagccacactgaccgtggacacctctatcagcaccgcctacatggaactgagccggctgagatccgatgacaccgccgtgtactattgtgccagaggcagcgcctggtttccctattggggacagggaaccctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1410 - DNA, 1086 bp, Artificial Sequence
  Synthetic Polynucleotide
atggagatcgtgctgacacagagcccttctagcctgtctgccagcgtgggcgacagagtgaccatcacatgtagagccagcgagaacatctacagctacctggcctggtatcagcagaagcctggcaaggcccctaagctgctgatctacaacaccaagacactcggcgagggcgtgcccagcagattttctggttctggcagcggcaccgacttcaccctgaccatatctagcctgcagcctgaggacttcgccacctactactgccagcaccactacggcacccctttcacatttggccctggcaccaaggtggacatcaaaggcggaggcggaagtggaggcggaggatctggcggcggaggctctcaagttcagctggttcagagcggagccgaagtgaagaaacctggggcctctgtgaaggtgtcctgcaaggccagcggctacaccttcagcgactattgggtgcactgggtccgacaggctccaggacaaggactggaatggatgggagccatcgacggcagcgataccttcaacgattacagccagaaattcaaaggccgcgtgaccatgaccagagacaccagcatcagcaccgcctacatggaactgagccggctgagatccgatgacaccgccgtgtactattgtgccagaggcggcctgctgcagtattggggacagggaacactggtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1411 - DNA, 1098 bp, Artificial Sequence
  Synthetic Polynucleotide
atggagatcgtgctgacacagtctcccgccacactgtcactgtctccaggcgaaagagccacactgagctgtagcgccagcagcagcgtgtcctacatgcactggtatcagcagaagcccggacaggcccctagactgctgatctacgataccagcaagctggcctctgacatccccgccagattttctggcagcggctctggcaccgatttcaccctgaccataagcagcctggaacctgaggacttcgccgtgtactactgtcagcagggcagcgtgtaccccttcacatttggcggcggaacaaaggtggaaatcaaaggcggaggcggaagtggaggcggaggatctggcggcggaggctctcaagttcagctgcaagagtctggccctggcctggttaagcctagcggaacactgagcctgacctgtgctgtgtctggcggcagcatcagcacatctggcatgggcgttggctgggtccgacagcctcctggaaaaggcctggaatggatcggccacatttggtgggacgacgacaagcggtacaaccccgctctgaagtccagagtgaccatcagcgtggacaagagcaagaaccagttcagcctgcggctgagcagcgtgacagctgcagataccgccgtgtattattgcgcccggatggaactgtggtcctactacttcgactactggggcaagggcaccaccgtgactgtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1412 - DNA, 1110 bp, Artificial Sequence
  Synthetic Polynucleotide
atggacatccagatgacccagaccacaagcagcctgtctgccagcctgggcgacagagtgaccatctcttgtagagccagccaggacatcagcaactacctgaactggtatcagcagaaacccgacggcaccgtgaagctgctgatctactacaccagcatcctgcacagcggcgtgcccagcagattttctggctctggcagcggcaccgactacagcctgaccatcagcaatctggaacaagaggacttcgctacctacttctgccagcaaggcaacaccctgccttggacatttggcggaggcaccaagctggaaatcaaagctggcggaggcggaagtggaggcggaggatctggcggcggaggctctgaagtgcaactggttgaatctggcggcggactggttaagcctggcggatctctgaagctgagctgtgccgcctctggcttcgccttcagcatctacgatatgagctgggtccgacagacccctgagaagagactggaatgggtcgcctacatctctagcggcggagggacctactatcccgacacagtgaagggcagattcaccatctccagagacaacgccaagaacaccctgtacctccagatgagcagcctgaagtccgaggacaccgccatgtactactgcgccagacacagcggctatggcacacattggggagtgctgtttgcctactggggccagggaacactggtcacagtttctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1413 - DNA, 1110 bp, Artificial Sequence
  Synthetic Polynucleotide
atggatattcaactgacacaatcccccagctcactcagcgccagcgtgggggacagggttagctttacctgtcaagcctctcaggatataaataactttctgaactggtatcaacagaagcctgggaaggcgcccaaactcctgatctatgatgcgtccaacctggaaactggcgtgccttcacgctttagcggctctggcagtggtacagacttcacttttaccatctcttcacttcagccggaggacatcgccacatattactgtcaacagtacggaaacttgccctttacttttggaggcggcaccaaagttgaaatcaaaagaggcggaggcggaagtggaggcggaggatctggcggcggaggctctcaggtccaactgcaagaaagcggacccggactggtgaagccttctgagacacttagtctgacgtgcacggtcagtggcggctccatctcctcctattattggtcatggatacgacaacccccaggtaagggcctggaatggattggctatatctactattcaggaagcacgaactacaatcccagcctgaagtcccgagtgacaatttcagtagataccagtaaaaaccagttcagtcttaaactgtcaagcgtgacagctgccgacaccgctgtgtattactgcgtctcactggtgtattgtggaggggattgttatagcgggttcgattattggggacagggaaccctggtgactgtatcttccggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1414 - DNA, 1116 bp, Artificial Sequence
  Synthetic Polynucleotide
atggatatccagctcactcaaagcccctctagtctctctgcctcagtgggggatcgggtcagttttacttgtcaagcttcacaggatatcaacaacttccttaattggtatcagcagaagccaggaaaagcacccaagctgctcatctatgatgcctcaaatttggagacgggtgttcccagtcgattctctgggtcagggtccgggaccgactttacgtttacgatctcctctctgcagcccgaagacatcgccacatactattgtcaacagtacggcaacttgcctttcacatttgggggcgggactaaggttgaaatcaagaggggcggaggcggaagtggaggcggaggatctggcggcggaggctctcaggtacagctgcaggaatctgggcccggacttgtcaagccaagtcagacactttctcttacatgtaccgtgagcggcggaagtataagcagtggaggcttttactggtcttggatacggcagcacccaggcaaaggcttggagtggattggatacattcatcattcaggatctacacactataatccatcccttaagtcccgggtcaccattagcattgatacgtctaagaatctgttcagtctcaggctgtcctccgtcactgctgccgacacagccgtgtactactgcgcctccttggtttactgcggaggcgactgttatagcggctttgattattgggggcaggggaccctcgtaaccgtgagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1415 - DNA, 1116 bp, Artificial Sequence
  Synthetic Polynucleotide
atggacttcgtgatgacacagagccctctgagcctgcctgtgacacctggcgaacctgccagcatcagctgtagaagcagccagagcatcgtgcacagcaacggcaacacctacctggaatggtatctccagaagcctggacagagcccacagctgctgatctacaaggtgtccaacagattcagcggcgtgcccgacagattttctggcagcggctctggcaccgacttcaccctgaagattagcagagtggaagccgaggacgtgggcgtgtactactgcttccaaggctctcacgtgcccctgacctttggacagggcaccaagctggaaatcaagagaggcggaggcggaagtggaggcggaggatctggcggcggaggctctgaagtgcagctggttgaaagcggagccgaagtgaagaaacctggggcctctgtgaaggtgtcctgcaaggccagcggctacacctttaccagctactggattcactgggtccgacaggcccctggacaaggacttgagtggatgggcgagaacgacccctccaacggcaggaccaactacaacgagaagttcaagaaccgcgtgaccctgaccgtggacaccagcatctctaccgcctacatggaactgagccggctgagatccgatgacaccgccgtgtactattgcgccagaggacccaactacttttacagcatggactactggggccagggcacaatggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1416 - DNA, 1107 bp, Artificial Sequence
  Synthetic Polynucleotide
atggagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggcggaggcggaagtggaggcggaggatctggcggcggaggctctcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1417 - DNA, 1107 bp, Artificial Sequence
  Synthetic Polynucleotide
atgcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggcggaggcggaagtggaggcggaggatctggcggcggaggctctgagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1418 - DNA, 1125 bp, Artificial Sequence
  Synthetic Polynucleotide
atggacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggcggaggcggaagtggaggcggaggatctggcggcggaggctctcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1419 - DNA, 1125 bp, Artificial Sequence
  Synthetic Polynucleotide
atgcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggcggaggcggaagtggaggcggaggatctggcggcggaggctctgacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1420 - DNA, 1095 bp, Artificial Sequence
  Synthetic Polynucleotide
atggacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggcggaggcggaagtggaggcggaggatctggcggcggaggctctcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1421 - DNA, 1095 bp, Artificial Sequence
  Synthetic Polynucleotide
atgcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggcggaggcggaagtggaggcggaggatctggcggcggaggctctgacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1422 - DNA, 1072 bp, Artificial Sequence
  Synthetic Polynucleotide
atggagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1423 - DNA, 1072 bp, Artificial Sequence; identical to SEQ ID NO: 1422
  Synthetic Polynucleotide

SEQ ID NO: 1424 - DNA, 1084 bp, Artificial Sequence
  Synthetic Polynucleotide
atggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1425 - DNA, 1084 bp, Artificial Sequence; identical to SEQ ID NO: 1424
  Synthetic Polynucleotide

SEQ ID NO: 1426 - DNA, 1110 bp, Artificial Sequence
  Synthetic Polynucleotide
atggacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggcggaggcggaagtggaggcggaggatctggcggcggaggctctcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1427 - DNA, 1110 bp, Artificial Sequence
  Synthetic Polynucleotide
atgcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggcggaggcggaagtggaggcggaggatctggcggcggaggctctgacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1428 - DNA, 1119 bp, Artificial Sequence
  Synthetic Polynucleotide
atgcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggcggaggcggaagtggaggcggaggatctggcggcggaggctctcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1429 - DNA, 1119 bp, Artificial Sequence
  Synthetic Polynucleotide
atgcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggcggaggcggaagtggaggcggaggatctggcggcggaggctctcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1430 - DNA, 1095 bp, Artificial Sequence
  Synthetic Polynucleotide
atggacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggcggaggcggaagtggaggcggaggatctggcggcggaggctctcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1431 - DNA, 1095 bp, Artificial Sequence
  Synthetic Polynucleotide
atgcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggcggaggcggaagtggaggcggaggatctggcggcggaggctctgacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1432 - DNA, 1119 bp, Artificial Sequence
  Synthetic Polynucleotide
atggacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggcggaggcggaagtggaggcggaggatctggcggcggaggctctcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1433 - DNA, 1119 bp, Artificial Sequence
  Synthetic Polynucleotide
atgcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggcggaggcggaagtggaggcggaggatctggcggcggaggctctgacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1434 - DNA, 1104 bp, Artificial Sequence
  Synthetic Polynucleotide
atggacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggcggaggcggaagtggaggcggaggatctggcggcggaggctctgaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1435 - DNA, 1104 bp, Artificial Sequence
  Synthetic Polynucleotide
atggaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggcggaggcggaagtggaggcggaggatctggcggcggaggctctgacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1436 - DNA, 1095 bp, Artificial Sequence
  Synthetic Polynucleotide
atggacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1437 - DNA, 1095 bp, Artificial Sequence
  Synthetic Polynucleotide
atggaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggcggaggcggaagtggaggcggaggatctggcggcggaggctctgacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1438 - DNA, 1095 bp, Artificial Sequence
  Synthetic Polynucleotide
atggacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggcggaggcggaagtggaggcggaggatctggcggcggaggctctgaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1439 - DNA, 1095 bp, Artificial Sequence
  Synthetic Polynucleotide
atggaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggcggaggcggaagtggaggcggaggatctggcggcggaggctctgacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1440 - DNA, 1119 bp, Artificial Sequence
  Synthetic Polynucleotide
atgcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggcggaggcggaagtggaggcggaggatctggcggcggaggctctcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1441 - DNA, 1119 bp, Artificial Sequence
  Synthetic Polynucleotide
atgcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggcggaggcggaagtggaggcggaggatctggcggcggaggctctcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1442 - DNA, 1140 bp, Artificial Sequence
  Synthetic Polynucleotide
atggacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggcggaggcggaagtggaggcggaggatctggcggcggaggctctgaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1443 - DNA, 1140 bp, Artificial Sequence
  Synthetic Polynucleotide
atggaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggcggaggcggaagtggaggcggaggatctggcggcggaggctctgacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctggagcagaaactgatctcggaagaggatctgtga

SEQ ID NO: 1444 - DNA, 1056 bp, Artificial Sequence
  Synthetic Polynucleotide
atggtcgtgatgacccagacccctctgagcctgagcgtgacactgggacagcctgccagcatcagctgcaagagcagccagagcctgctgcacagcgacggcaagacctacctgaactggctgcagcagaggccaggccagagccctcggagactgatctacctggtgtccaagctggacagcggcgtgcccgatagattttccggctctggcagcggcaccgacttcaccctgaagatcagccgggtggaagccgaggacgtgggcatctactactgttggcagggcacccacctgtggacctttggcggcggaacaaaggtggaaatcaagggcggaggcggaagtggaggcggaggatctggcggcggaggctctgaagtgcacctggtggaaagcggcggaggactggtgcagccagggggatctctgagactgtcttgtgccgccagcggcttcaccttcagcagatacggcatgagctgggtgcgccaggcccctggaaaaggactggaactggtggctatgatgaagaccaagggcggcagaacctactaccccgacagcgtgaagggccggttcaccatctcccgggacaacgccaagaacagcctgtacctgcagatgaactccctgcgggccgaggacaccgccatctactattgtgcctccgacggctactactggggccagggaacaaccgtcaccgtgtcctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1445 - DNA, 1065 bp, Artificial Sequence
  Synthetic Polynucleotide
atggagatcgtgctgacacagtctcccgccacactgtcactgtctccaggcgaaagagccacactgagctgtagcgccaccagcagcgtgtcctacatgcactggtatcagcagaagcccggcaaggcccctaagcggtggatctacgataccagcaaactggcctctggcgtgcccagcagattttctggctctggcagcggcaccgagttcaccctgacaatatctagcctccagcctgaggacttcgccacctactactgccagcagtggtccagcaatcccctgacctttggacagggcaccaagctggaaatcaaaggcggaggcggaagtggaggcggaggatctggcggcggaggctctcaagttcagctggttcagtctggggccgaagtgaagaaacctggggcctctgtgaaggtgtcctgcaaggccagcggctacaagttcaccagctacgtgatgcactgggtccgacaggctccaggacaaggactggaatggatcggctacatcaacccctacaacgacgtgaccaagtacaacgagaagttcaagggcagagtgaccatcaccgccgacaagagcacaagcaccgcctacatggaactgagcagcctgagaagcgaggacaccgccgtgcactattgtgccagaggcagctactacgactacgacggctttgtgtattggggccagggcaccctggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1446 - DNA, 1080 bp, Artificial Sequence
  Synthetic Polynucleotide
atggacatcgtgatgacacagagccctgatagcctggccgtgtctctgggagagagagccaccatcaactgcaagagcagccagagcctgctgaacagccggaccagaaagaactacctggcctggtatcagcagaagcccggacagtctcccaagctgctgatctactggaccagcaccagaaagtccggcgtgcccgatagattttctggctctggcagcggcaccgacttcaccctgacaatttctagcctgcaagccgaggacgtggccgtgtactactgcaagcagagcttcatcctgcggacctttggccagggcaccaaggtggaaatcaaaggcggaggcggaagtggaggcggaggatctggcggcggaggctctgaagttcagctggttcagagcggagccgaagtgaagaaacctggggcctctgtgaaggtgtcctgcaaggcttccggcttcaccttcaccagctactacatccactgggtccgacaggcccctggacaaggactggaatggatcggctggatctaccccgagaacgacaacaccaagtacaacgagaagttcaaggaccgcgtgaccatcaccgccgataccagcacaagcaccgcctacctggaactgagcagcctgagaagcgaggacaccgccgtgtattattgcgccagagatgcctacagccggtactacttcgactactggggccagggaaccctggtcacagtctcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1447 - DNA, 1089 bp, Artificial Sequence
  Synthetic Polynucleotide
atggacatcgtgatgacacagagccctctgagcctgcctgtgacacctggcgaacctgccagcatcagctgtagaagcagccagagactgctgagcagctacggccacacatacctgcactggtatctccagaagcctggacagagcccacagctgctgatctacgaggtgtccaacagattcagcggcgtgcccgatagattttccggctctggcagcggcaccgacttcaccctgaagattagcagagtggaagccgaggacgtgggcgtgtactactgtagccagagcacacacgtgcccctgacctttggacagggcaccaaggtggaaatcaaaggcggaggcggaagtggaggcggaggatctggcggcggaggctctgaagtgcagctggttgaatctggcggcggactggttaagcctggcggatctctgagactgagctgtgccgccagcggctacaccttcagcaattactggatcggctgggtccgacaggcccctggaaaaggactggaatggatcggcgacatctaccctggcggcaactacatcagaaacaacgagaagttcaaggacaagaccacactgagcgccgacaccagcaagaacacagcctacctccagatgaacagcctgaaaaccgaggacaccgccgtgtactattgcggcagcagcttcggcagcaactacgtgttcgcctggttcacctattggggccagggcacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1448 - DNA, 1083 bp, Artificial Sequence
  Synthetic Polynucleotide
atggacatcgtgatgtctcagagccctagcagcctggctgtgtccgctggcgagaaagtgaccatgagctgcaagagcagccagagcctgttcaacagccggaccagaaagaactacctggcctggtatcagcagaagcccggacagtctcccaagctgctgatctactgggccagcgccagagatagcggagtgcctgctagattcacaggcagcggcagcgagacatacttcaccctgaccatcagcagagtgcaggccgaggatctggccgtgtactactgtatgcagagcttcaacctgcggaccttcggcggaggcaccaagctggaaatcaaaggcggaggcggaagtggaggcggaggatctggcggcggaggctctgaagtgaacctggttgaatccggcggaggactggttcagcctggcggatctctgagactgagctgtgccaccagcggcttcaccttcaccgacaactacatgagctgggtccgacagcctcctggcaaagctctggaatggctgggcttcatcagaaacaaggccaacggctacaccaccgactacagcgcctctgtgcggggcagattcaccatctccagagacaacagccagtccatcctgtacctccagatgaacgccctgagagccgaggatagcgccacctactactgtgccagagatgtgggcagcaactacttcgactattggggccagggcaccacactgaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1449 - DNA, 1086 bp, Artificial Sequence
  Synthetic Polynucleotide
atggacatcgtgatgacacagagccctgatagcctggccgtgtctctcggcgagcgcgtgacaatgaattgcaagagcagccagagcctgctgtactccaccaaccagaagaactacctggcctggtatcagcagaagcccggacagtctcccaagctgctgatctactgggccagcaccagagaaagcggcgtgcccgatagattttctggctctggcagcggcaccgacttcaccctgacaatcagttctgtgcaggccgaggacgtggccgtgtactactgccagcagtattacagctaccggaccttcggcggaggcaccaagctggaaatcaaaggcggaggcggaagtggaggcggaggatctggcggcggaggctctcaagttcagctccagcagtctggccccgagtggaaacctggcgcttctgtgaagatgagctgcaaggccagcggctacaccttcaccagctacgtgatccactgggtccgacagaagcctggccaaggactggattggatcggctacatcaacccctacaacgacggcaccgattacgacgagaagttcaagggcaaagccacactgaccagcgacaccagcacaagcaccgcctacatggaactgagcagcctgagaagcgaggacaccgccgtgtattattgcgccagagagaaggacaactacgccaccggcgcttggtttgcctattggggccagggaacactggtcaccgttagctctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1450 - DNA, 1074 bp, Artificial Sequence
  Synthetic Polynucleotide
atggacatccagatgacacagagccctagcagcctgtctgccagcgtgggagacagagtgaccatcacctgtagagccagccaggacatcagaaactacctgaactggtatcagcagaagcccggcaaggcccctaagctgctgatctactacaccagcagactggaaagcggcgtgcccagcagattttctggcagcggctctggcaccgactacaccctgacaatatccagcctccagcctgaggacttcgccacctactattgccagcagggcaacaccctgccttggacatttggccagggcaccaaggtggaaatcaaaggcggaggcggaagtggaggcggaggatctggcggcggaggctctgaagtgcagctggttgaatcaggtggcggcctggttcaacctggcggatctctgagactgagctgtgccgccagcggctacagctttaccggctacaccatgaactgggtccgacaggcccctggcaaaggactggaatgggtcgccctgattaacccctacaagggcgtgtccacctacaaccagaagttcaaggacaggttcaccatcagcgtggacaagagcaagaacaccgcctacctccagatgaactccctgagagccgaggacaccgccgtgtactattgtgccagaagcggctactacggcgacagcgactggtactttgatgtgtggggccagggaaccctggtcaccgtttcttctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1451 - DNA, 1080 bp, Artificial Sequence
  Synthetic Polynucleotide
atgagcacaggatctcaggtgcagctccagcagtctggccctgagcttgtgaaacctggcgcttccgtgaagatgagctgcaaggccagcggctacaccttcaccgactatgtgattaactggggcaagcagcggagcggccaaggactggaatggatcggcgaaatctaccctggcagcggcaccaactactacaacgagaagttcaaggccaaggccacactgaccgccgacaagagcagcaatatcgcctacatgcagctgagcagcctgaccagcgaagatagcgccgtgtacttctgcgccagaagaggcagatacggcctgtacgctatggactattggggccagggcaccagcgtgacagtgtcatctggcggaggcggaagtggaggcggaggatctggcggcggaggctctgacatccagatgacccagacaaccagcagcctgtctgccagcctgggcgatagagtgaccatcagctgtagagccagccaggacatcagcaactacctgaactggtatcagcagaaacccgacggcaccgtgaagctgctgatctactacaccagcagactgcacagcggcgtgcccagcagattttctggctctggaagcggcacagattactccctgaccatcaacaacctggaacaagaggacattgccacctacttttgccagcaaggcaacacccggccttggacatttggcggaggcaccaagctggaaatcaagggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1452 - DNA, 1065 bp, Artificial Sequence
  Synthetic Polynucleotide
atgcagatcgtgctgacacagagccctgccatcatgagcgcttccccaggcgagaaagtgaccatgacctgtagcgccacaagcagcgtgtcctacatgcactggtatcagcagaagtccggcacaagccccaagcggtggatctacgataccagcaaactggcctctggcgtgcccgctagattttctggctctggcagcggcaccagctacagcctgacaatcagcagcatggaagccgaggatgccgccacctactactgccagcagtggtccagcaatcccctgacatttggagccggcaccaagctggaactgaaaggcggaggcggaagtggaggcggaggatctggcggcggaggctctgaagttcagctccagcagtctggccccgagcttgtgaaacctggcgcttccgtgaagatgagctgcaaggccagcggctacaagttcacctcctacgtgatgcactgggtcaagcagaaacccggccagggccttgagtggatcggctacatcaacccctacaacgacgtgaccaagtacaacgagaagttcaagggcaaagccacactgaccagcgacaagagcagcagcaccgcctacatggaactgagcagcctgacctctgaggacagcgccgtgcactattgtgccagaggcagctactacgactacgacggctttgtgtattggggccagggcaccctggttaccgtttctgctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1453 - DNA, 1068 bp, Artificial Sequence
  Synthetic Polynucleotide
atggacatccagatgacacagagccctgccagccagtctgcctctctgggagagtctgtgaccatcacctgtctggcctctcagaccatcggaacatggctggcctggtatcagcagaagcctggcaagtctccccagctgctgatctacgccgctacatctctggctgatggcgtgcccagcagattttctggcagcggctccggcaccaagttcagcctgaagatcagaaccctccaggccgaggacttcgtgtcctactattgccagcagctgtactccaagccttacacctttggcggaggcaccaagctggaaatcaagagaggcggaggcggaagtggaggcggaggatctggcggcggaggctctgaagttcagctgcaacagagcggagccgagctggttaagcctggcgcttctgtgaagctgagctgtacccctagcggcttcaacgtgaaggacacctacatccactgggtcaagcagcggcctaagcagggcctcgaatggatcggaagaatcgaccctagcgacggcgacattaagtacgaccccaagttccagggcaaagccaccatcaccgccgacaccagcagcaacacagtgtctctccagctgagcagcctgaccagcgaagataccgccgtgtactattgcgcccgttggttcggcgattacggggccatgaattattggggccagggcaccagcgtgaccgtgtcatctggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagcccgaaaaggatgagctg

SEQ ID NO: 1454 - skipped

SEQ ID NO: 1455 - DNA, 1473 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1456 - DNA, 1473 bp, Artificial Sequence
  Synthetic Polynucleotide
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1457 - DNA, 1473 bp, Artificial Sequence
  Synthetic Polynucleotide
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1458 - DNA, 1476 bp, Artificial Sequence
  Synthetic Polynucleotide
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1459 - DNA, 1497 bp, Artificial Sequence
  Synthetic Polynucleotide
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1460 - DNA, 1548 bp, Artificial Sequence
  Synthetic Polynucleotide
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1461 - DNA, 1479 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1462 - DNA, 1476 bp, Artificial Sequence
  Synthetic Polynucleotide
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1463 - DNA, 1494 bp, Artificial Sequence
  Synthetic Polynucleotide
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1464 - DNA, 1509 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1465 - DNA, 1470 bp, Artificial Sequence
  Synthetic Polynucleotide
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1466 - DNA, 1500 bp, Artificial Sequence
  Synthetic Polynucleotide
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1467 - DNA, 1473 bp, Artificial Sequence
  Synthetic Polynucleotide
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1468 - DNA, 1485 bp, Artificial Sequence
  Synthetic Polynucleotide
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1469 - DNA, 1479 bp, Artificial Sequence
  Synthetic Polynucleotide
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1470 - DNA, 1479 bp, Artificial Sequence
  Synthetic Polynucleotide
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1471 - DNA, 1482 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1472 - DNA, 1476 bp, Artificial Sequence
  Synthetic Polynucleotide
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1473 - DNA, 1509 bp, Artificial Sequence
  Synthetic Polynucleotide
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1474 - DNA, 1476 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1475 - DNA, 1479 bp, Artificial Sequence
  Synthetic Polynucleotide
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1476 - DNA, 1482 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1477 - DNA, 1482 bp, Artificial Sequence
  Synthetic Polynucleotide
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1478 - DNA, 1482 bp, Artificial Sequence; identical to SEQ ID NO: 1477
  Synthetic Polynucleotide

SEQ ID NO: 1479 - DNA, 1482 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1480 - DNA, 1488 bp, Artificial Sequence
  Synthetic Polynucleotide
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1481 - DNA, 1479 bp, Artificial Sequence
  Synthetic Polynucleotide
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1482 - DNA, 1488 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1483 - DNA, 1482 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1484 - DNA, 1479 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1485 - DNA, 1509 bp, Artificial Sequence
  Synthetic Polynucleotide
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1486 - DNA, 1485 bp, Artificial Sequence
  Synthetic Polynucleotide
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1487 - DNA, 1479 bp, Artificial Sequence; identical to SEQ ID NO: 1484
  Synthetic Polynucleotide

SEQ ID NO: 1488 - DNA, 1476 bp, Artificial Sequence
  Synthetic Polynucleotide
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1489 - DNA, 1482 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1490 - DNA, 1476 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1491 - DNA, 1491 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1492 - DNA, 1467 bp, Artificial Sequence
  Synthetic Polynucleotide
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1493 - DNA, 1485 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1494 - DNA, 1485 bp, Artificial Sequence
  Synthetic Polynucleotide
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1495 - DNA, 1464 bp, Artificial Sequence
  Synthetic Polynucleotide
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1496 - DNA, 1479 bp, Artificial Sequence
  Synthetic Polynucleotide
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1497 - DNA, 1470 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1498 - DNA, 1500 bp, Artificial Sequence
  Synthetic Polynucleotide
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1499 - DNA, 1488 bp, Artificial Sequence
  Synthetic Polynucleotide
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1500 - DNA, 1566 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1501 - DNA, 1563 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1502 - DNA, 1611 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1503 - DNA, 1479 bp, Artificial Sequence
  Synthetic Polynucleotide
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1504 - DNA, 1476 bp, Artificial Sequence
  Synthetic Polynucleotide
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1505 - DNA, 1467 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1506 - DNA, 1497 bp, Artificial Sequence
  Synthetic Polynucleotide
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1507 - DNA, 1458 bp, Artificial Sequence
  Synthetic Polynucleotide
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1508 - DNA, 1482 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1509 - DNA, 1470 bp, Artificial Sequence
  Synthetic Polynucleotide
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1510 - DNA, 1482 bp, Artificial Sequence
  Synthetic Polynucleotide
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1511 - DNA, 1470 bp, Artificial Sequence
  Synthetic Polynucleotide
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1512 - DNA, 1494 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1513 - DNA, 1479 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1514 - DNA, 1491 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1515 - DNA, 1491 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1516 - DNA, 1473 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1517 - DNA, 1479 bp, Artificial Sequence
  Synthetic Polynucleotide
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1518 - DNA, 1470 bp, Artificial Sequence
  Synthetic Polynucleotide
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1519 - DNA, 1473 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1520 - DNA, 1461 bp, Artificial Sequence
  Synthetic Polynucleotide
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1521 - DNA, 1554 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1522 - DNA, 1467 bp, Artificial Sequence
  Synthetic Polynucleotide
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1523 - DNA, 1494 bp, Artificial Sequence
  Synthetic Polynucleotide
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1524 - DNA, 1506 bp, Artificial Sequence
  Synthetic Polynucleotide
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1525 - DNA, 1479 bp, Artificial Sequence
  Synthetic Polynucleotide
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1526 - DNA, 1464 bp, Artificial Sequence
  Synthetic Polynucleotide
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1527 - DNA, 1473 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1528 - DNA, 1458 bp, Artificial Sequence
  Synthetic Polynucleotide
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1529 - DNA, 1488 bp, Artificial Sequence
  Synthetic Polynucleotide
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1530 - DNA, 1464 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1531 - DNA, 1473 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1532 - DNA, 1503 bp, Artificial Sequence
  Synthetic Polynucleotide
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1533 - DNA, 1494 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1534 - DNA, 1470 bp, Artificial Sequence
  Synthetic Polynucleotide
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1535 - DNA, 1449 bp, Artificial Sequence
  Synthetic Polynucleotide
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1536 - DNA, 1464 bp, Artificial Sequence
  Synthetic Polynucleotide
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1537 - DNA, 1473 bp, Artificial Sequence
  Synthetic Polynucleotide
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1538 - DNA, 1488 bp, Artificial Sequence
  Synthetic Polynucleotide
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1539 - DNA, 1473 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1540 - DNA, 1491 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1541 - DNA, 1485 bp, Artificial Sequence
  Synthetic Polynucleotide
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1542 - DNA, 1485 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1543 - DNA, 1479 bp, Artificial Sequence
  Synthetic Polynucleotide
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1544 - DNA, 1470 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1545 - DNA, 1473 bp, Artificial Sequence
  Synthetic Polynucleotide
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1546 - DNA, 1479 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1547 - DNA, 1482 bp, Artificial Sequence
  Synthetic Polynucleotide
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1548 - DNA, 1482 bp, Artificial Sequence
  Synthetic Polynucleotide
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1549 - DNA, 1482 bp, Artificial Sequence
  Synthetic Polynucleotide
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1550 - DNA, 1476 bp, Artificial Sequence
  Synthetic Polynucleotide
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1551 - DNA, 1476 bp, Artificial Sequence
  Synthetic Polynucleotide
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1552 - DNA, 1491 bp, Artificial Sequence
  Synthetic Polynucleotide
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1553 - DNA, 1491 bp, Artificial Sequence
  Synthetic Polynucleotide
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1554 - DNA, 1485 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1555 - DNA, 1470 bp, Artificial Sequence
  Synthetic Polynucleotide
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1556 - DNA, 1455 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1557 - DNA, 1473 bp, Artificial Sequence
  Synthetic Polynucleotide
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1558 - DNA, 1494 bp, Artificial Sequence
  Synthetic Polynucleotide
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1559 - DNA, 1497 bp, Artificial Sequence
  Synthetic Polynucleotide
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1560 - DNA, 1488 bp, Artificial Sequence
  Synthetic Polynucleotide
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1561 - DNA, 1479 bp, Artificial Sequence
  Synthetic Polynucleotide
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1562 - DNA, 1512 bp, Artificial Sequence
  Synthetic Polynucleotide
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1563 - DNA, 1500 bp, Artificial Sequence
  Synthetic Polynucleotide
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1564 - DNA, 1482 bp, Artificial Sequence
  Synthetic Polynucleotide
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1565 - DNA, 1473 bp, Artificial Sequence
  Synthetic Polynucleotide
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1566 - DNA, 1467 bp, Artificial Sequence
  Synthetic Polynucleotide
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1567 - DNA, 1473 bp, Artificial Sequence
  Synthetic Polynucleotide
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1568 - DNA, 1479 bp, Artificial Sequence
  Synthetic Polynucleotide
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1569 - DNA, 1494 bp, Artificial Sequence
  Synthetic Polynucleotide
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1570 - DNA, 1476 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1571 - DNA, 1479 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1572 - DNA, 1476 bp, Artificial Sequence
  Synthetic Polynucleotide
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1573 - DNA, 1473 bp, Artificial Sequence
  Synthetic Polynucleotide
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1574 - DNA, 1473 bp, Artificial Sequence
  Synthetic Polynucleotide
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1575 - DNA, 1479 bp, Artificial Sequence
  Synthetic Polynucleotide
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1576 - DNA, 1473 bp, Artificial Sequence
  Synthetic Polynucleotide
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1577 - DNA, 1470 bp, Artificial Sequence
  Synthetic Polynucleotide
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1578 - DNA, 1470 bp, Artificial Sequence
  Synthetic Polynucleotide
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1579 - DNA, 1494 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1580 - DNA, 1512 bp, Artificial Sequence
  Synthetic Polynucleotide
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1581 - DNA, 1467 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1582 - DNA, 1497 bp, Artificial Sequence
  Synthetic Polynucleotide
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1583 - DNA, 1485 bp, Artificial Sequence
  Synthetic Polynucleotide
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1584 - DNA, 1437 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1585 - DNA, 1467 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1586 - DNA, 1479 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1587 - DNA, 1467 bp, Artificial Sequence
  Synthetic Polynucleotide
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1588 - DNA, 1470 bp, Artificial Sequence
  Synthetic Polynucleotide
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1589 - DNA, 1485 bp, Artificial Sequence
  Synthetic Polynucleotide
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1590 - DNA, 1467 bp, Artificial Sequence
  Synthetic Polynucleotide
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1591 - DNA, 1470 bp, Artificial Sequence
  Synthetic Polynucleotide
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1592 - DNA, 1494 bp, Artificial Sequence
  Synthetic Polynucleotide
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1593 - DNA, 1482 bp, Artificial Sequence; identical to SEQ ID NO: 1510
  Synthetic Polynucleotide

SEQ ID NO: 1594 - DNA, 1473 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1595 - DNA, 1473 bp, Artificial Sequence
  Synthetic Polynucleotide
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1596 - DNA, 1470 bp, Artificial Sequence
  Synthetic Polynucleotide
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1597 - DNA, 1467 bp, Artificial Sequence
  Synthetic Polynucleotide
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1598 - DNA, 1470 bp, Artificial Sequence
  Synthetic Polynucleotide
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1599 - DNA, 1482 bp, Artificial Sequence
  Synthetic Polynucleotide
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1600 - DNA, 1491 bp, Artificial Sequence
  Synthetic Polynucleotide
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1601 - DNA, 1497 bp, Artificial Sequence
  Synthetic Polynucleotide
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1602 - DNA, 1494 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1603 - DNA, 1464 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1604 - DNA, 1470 bp, Artificial Sequence
  Synthetic Polynucleotide
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1605 - DNA, 1470 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1606 - DNA, 1473 bp, Artificial Sequence
  Synthetic Polynucleotide
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1607 - DNA, 1467 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1608 - DNA, 1524 bp, Artificial Sequence
  Synthetic Polynucleotide
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1609 - DNA, 1515 bp, Artificial Sequence
  Synthetic Polynucleotide
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1610 - DNA, 1437 bp, Artificial Sequence
  Synthetic Polynucleotide
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1611 - DNA, 1485 bp, Artificial Sequence
  Synthetic Polynucleotide
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1612 - DNA, 1458 bp, Artificial Sequence
  Synthetic Polynucleotide
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1613 - DNA, 1461 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1614 - DNA, 1461 bp, Artificial Sequence
  Synthetic Polynucleotide
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1615 - DNA, 1494 bp, Artificial Sequence
  Synthetic Polynucleotide
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1616 - DNA, 1482 bp, Artificial Sequence
  Synthetic Polynucleotide
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1617 - DNA, 1467 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1618 - DNA, 1479 bp, Artificial Sequence
  Synthetic Polynucleotide
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1619 - DNA, 1506 bp, Artificial Sequence
  Synthetic Polynucleotide
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1620 - DNA, 1479 bp, Artificial Sequence
  Synthetic Polynucleotide
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1621 - DNA, 1488 bp, Artificial Sequence
  Synthetic Polynucleotide
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1622 - DNA, 1473 bp, Artificial Sequence
  Synthetic Polynucleotide
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1623 - DNA, 1476 bp, Artificial Sequence
  Synthetic Polynucleotide
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1624 - DNA, 1467 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1625 - DNA, 1503 bp, Artificial Sequence
  Synthetic Polynucleotide
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1626 - DNA, 1473 bp, Artificial Sequence
  Synthetic Polynucleotide
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1627 - DNA, 1464 bp, Artificial Sequence
  Synthetic Polynucleotide
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1628 - DNA, 1479 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1629 - DNA, 1476 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1630 - DNA, 1482 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1631 - DNA, 1470 bp, Artificial Sequence
  Synthetic Polynucleotide
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1632 - DNA, 1464 bp, Artificial Sequence
  Synthetic Polynucleotide
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1633 - DNA, 1497 bp, Artificial Sequence
  Synthetic Polynucleotide
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1634 - DNA, 1482 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1635 - DNA, 1485 bp, Artificial Sequence
  Synthetic Polynucleotide
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1636 - DNA, 1485 bp, Artificial Sequence
  Synthetic Polynucleotide
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1637 - DNA, 1521 bp, Artificial Sequence
  Synthetic Polynucleotide
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1638 - DNA, 1503 bp, Artificial Sequence
  Synthetic Polynucleotide
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1639 - DNA, 1473 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1640 - DNA, 1470 bp, Artificial Sequence
  Synthetic Polynucleotide
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1641 - DNA, 1476 bp, Artificial Sequence
  Synthetic Polynucleotide
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1642 - DNA, 1449 bp, Artificial Sequence
  Synthetic Polynucleotide
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1643 - DNA, 1458 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1644 - DNA, 1479 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1645 - DNA, 1467 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1646 - DNA, 1470 bp, Artificial Sequence
  Synthetic Polynucleotide
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1647 - DNA, 1473 bp, Artificial Sequence
  Synthetic Polynucleotide
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1648 - DNA, 1488 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1649 - DNA, 1512 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1650 - DNA, 1494 bp, Artificial Sequence
  Synthetic Polynucleotide
atggccttaccagtgaccgccttgctcctgccgctggccttgctgctccacgccgccaggccggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacgccgcctaccctacttttggcggagggaccaaggttgagatcaaacggggcggaggcggaagtggaggcggaggatctggcggcggaggctctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggcggtgtactactgcgccagagagagttggccaatggacgtatggggccagggaacaactgtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1651 - DNA, 1509 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaaaggcggaggcggaagtggaggcggaggatctggcggcggaggctctcaaatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1652 - DNA, 1500 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagaatctcctggcctttcacttttggcggagggaccaaggttgagatcaaaggcggaggcggaagtggaggcggaggatctggcggcggaggctctgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggcggtgtactactgcgcaagagccgagatgggagccgtattcgacatatggggtcagggtacaatggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1653 - DNA, 1515 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagacacgtctggcctcctacttttggcggagggaccaaggttgagatcaaacggggcggaggcggaagtggaggcggaggatctggcggcggaggctctcagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagaggcaggggatatgcaaccagcttagccttcgatatctggggtcagggtacaatggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1654 - DNA, 1530 bp, Artificial Sequence
  Synthetic Polynucleotide
atggccttaccagtgaccgccttgctcctgccgctggccttgctgctccacgccgccaggccggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagggactcggcctccctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgccagagacggtacttatctaggtggtctctggtacttcgacttatgggggagaggtaccttggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1655 - DNA, 1545 bp, Artificial Sequence
  Synthetic Polynucleotide
atggccttaccagtgaccgccttgctcctgccgctggccttgctgctccacgccgccaggccggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgcccacactcctttcacttttggcggagggaccaaggttgagatcaaacggggcggaggcggaagtggaggcggaggatctggcggcggaggctctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagaactcctgaatactcctccagcatatggcactattactacggcatggacgtatggggccagggaacaactgtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1656 - DNA, 1518 bp, Artificial Sequence
  Synthetic Polynucleotide
atggccttaccagtgaccgccttgctcctgccgctggccttgctgctccacgccgccaggccggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatagcgcatccaccagggccactggtatcccagccaggttcagtggcagtgggtctgggacagagttcactctcaccatcagcagcctgcagtctgaagattttgcagtttattactgtcagcagcaccacgtctggcctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgtcaaggggccgttgcaggagccgccatacgattatggaatggacgtatggggccagggaacaactgtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1657 - DNA, 1506 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattctactacccttggacttttggcggagggaccaaggttgagatcaaacggggcggaggcggaagtggaggcggaggatctggcggcggaggctctgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcaaccattagtagtagtagtagtaccatatactacgcagactctgtgaagggccgattcaccatctccagagacaatgccaagaactcactgtatctgcaaatgaacagcctgagagctgaggacacggcggtgtactactgcgccagaggttctcaggagcacctgattttcgattattggggacagggtacattggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1658 - DNA, 1521 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtaccgccagcagcagagtgtccagcagctacctgcactggttccagcagaagcctggcaaggcccctaagctgctgatctacagcaccagcaatctggcctctggcgtgcccagcagattttctggctctggcagcggcaccgacttcaccctgacaatatctagcctccagcctgaggacttcgccacctactactgccaccagtaccacagaagcccctacacattcggccagggcaccaaggtggaaatcaagagaggcggaggcggaagtggaggcggaggatctggcggcggaggctctgaagttcagctggttgaatctggcggcggactggttcaacctggcggatctctgagactgagctgtgccgcctctggctacgccttcagcaacagctggatcaactgggtccgacaggcccctggcaaaggactggaatgggtcggacaaatctaccccggcgactacgacaccaactacaacggcaagttcaagggcagattcaccatcagccgggacaagagcaagaacaccgcctacctccagatgaactccctgagagccgaggacaccgccgtgtactattgtgctagaggcggctccatctactacggcaacctgggcttcttcgacgtgtggggacagggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1659 - DNA, 1491 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgtagcgccagcagcagcgtgacctacatgtactggtatcagcagaagcccggcaaggcccctaagctgctgatctacgacaccagcaatctggcctctggcgtgcccagcagattttctggctctggcagcggcaccgactacaccctgacaatatctagcctccagcctgaggacttcgccacctactactgccagcagtggtccaactatcccctgacattcggccagggcaccaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacagcttcatcgagtacaccatcaactgggtccgacaggcccctggacaaggcctggaatggatcggcaacatcgacccctactacggcacaacctactacaaccagatgttcaccggcagagccacactgaccgtggacacctctatcagcaccgcctacatggaactgagccggctgagatccgatgacaccgccgtgtactattgtgccagaggcagcgcctggtttccctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1660 - DNA, 1491 bp, Artificial Sequence
  Synthetic Polynucleotide
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcgagaacatctacagctacctggcctggtatcagcagaagcctggcaaggcccctaagctgctgatctacaacaccaagacactcggcgagggcgtgcccagcagattttctggttctggcagcggcaccgacttcaccctgaccatatctagcctgcagcctgaggacttcgccacctactactgccagcaccactacggcacccctttcacatttggccctggcaccaaggtggacatcaaaggcggaggcggaagtggaggcggaggatctggcggcggaggctctcaagttcagctggttcagagcggagccgaagtgaagaaacctggggcctctgtgaaggtgtcctgcaaggccagcggctacaccttcagcgactattgggtgcactgggtccgacaggctccaggacaaggactggaatggatgggagccatcgacggcagcgataccttcaacgattacagccagaaattcaaaggccgcgtgaccatgaccagagacaccagcatcagcaccgcctacatggaactgagccggctgagatccgatgacaccgccgtgtactattgtgccagaggcggcctgctgcagtattggggacagggaacactggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1661 - DNA, 1503 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgcactggtatcagcagaagcccggacaggcccctagactgctgatctacgataccagcaagctggcctctgacatccccgccagattttctggcagcggctctggcaccgatttcaccctgaccataagcagcctggaacctgaggacttcgccgtgtactactgtcagcagggcagcgtgtaccccttcacatttggcggcggaacaaaggtggaaatcaaaggcggaggcggaagtggaggcggaggatctggcggcggaggctctcaagttcagctgcaagagtctggccctggcctggttaagcctagcggaacactgagcctgacctgtgctgtgtctggcggcagcatcagcacatctggcatgggcgttggctgggtccgacagcctcctggaaaaggcctggaatggatcggccacatttggtgggacgacgacaagcggtacaaccccgctctgaagtccagagtgaccatcagcgtggacaagagcaagaaccagttcagcctgcggctgagcagcgtgacagctgcagataccgccgtgtattattgcgcccggatggaactgtggtcctactacttcgactactggggcaagggcaccaccgtgactgtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1662 - DNA, 1515 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgacagagtgaccatctcttgtagagccagccaggacatcagcaactacctgaactggtatcagcagaaacccgacggcaccgtgaagctgctgatctactacaccagcatcctgcacagcggcgtgcccagcagattttctggctctggcagcggcaccgactacagcctgaccatcagcaatctggaacaagaggacttcgctacctacttctgccagcaaggcaacaccctgccttggacatttggcggaggcaccaagctggaaatcaaagctggcggaggcggaagtggaggcggaggatctggcggcggaggctctgaagtgcaactggttgaatctggcggcggactggttaagcctggcggatctctgaagctgagctgtgccgcctctggcttcgccttcagcatctacgatatgagctgggtccgacagacccctgagaagagactggaatgggtcgcctacatctctagcggcggagggacctactatcccgacacagtgaagggcagattcaccatctccagagacaacgccaagaacaccctgtacctccagatgagcagcctgaagtccgaggacaccgccatgtactactgcgccagacacagcggctatggcacacattggggagtgctgtttgcctactggggccagggaacactggtcacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1663 - DNA, 1515 bp, Artificial Sequence
  Synthetic Polynucleotide
atggccttaccagtgaccgccttgctcctgccgctggccttgctgctccacgccgccaggccggatattcaactgacacaatcccccagctcactcagcgccagcgtgggggacagggttagctttacctgtcaagcctctcaggatataaataactttctgaactggtatcaacagaagcctgggaaggcgcccaaactcctgatctatgatgcgtccaacctggaaactggcgtgccttcacgctttagcggctctggcagtggtacagacttcacttttaccatctcttcacttcagccggaggacatcgccacatattactgtcaacagtacggaaacttgccctttacttttggaggcggcaccaaagttgaaatcaaaagaggcggaggcggaagtggaggcggaggatctggcggcggaggctctcaggtccaactgcaagaaagcggacccggactggtgaagccttctgagacacttagtctgacgtgcacggtcagtggcggctccatctcctcctattattggtcatggatacgacaacccccaggtaagggcctggaatggattggctatatctactattcaggaagcacgaactacaatcccagcctgaagtcccgagtgacaatttcagtagataccagtaaaaaccagttcagtcttaaactgtcaagcgtgacagctgccgacaccgctgtgtattactgcgtctcactggtgtattgtggaggggattgttatagcgggttcgattattggggacagggaaccctggtgactgtatcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1664 - DNA, 1521 bp, Artificial Sequence
  Synthetic Polynucleotide
atggccttaccagtgaccgccttgctcctgccgctggccttgctgctccacgccgccaggccggatatccagctcactcaaagcccctctagtctctctgcctcagtgggggatcgggtcagttttacttgtcaagcttcacaggatatcaacaacttccttaattggtatcagcagaagccaggaaaagcacccaagctgctcatctatgatgcctcaaatttggagacgggtgttcccagtcgattctctgggtcagggtccgggaccgactttacgtttacgatctcctctctgcagcccgaagacatcgccacatactattgtcaacagtacggcaacttgcctttcacatttgggggcgggactaaggttgaaatcaagaggggcggaggcggaagtggaggcggaggatctggcggcggaggctctcaggtacagctgcaggaatctgggcccggacttgtcaagccaagtcagacactttctcttacatgtaccgtgagcggcggaagtataagcagtggaggcttttactggtcttggatacggcagcacccaggcaaaggcttggagtggattggatacattcatcattcaggatctacacactataatccatcccttaagtcccgggtcaccattagcattgatacgtctaagaatctgttcagtctcaggctgtcctccgtcactgctgccgacacagccgtgtactactgcgcctccttggtttactgcggaggcgactgttatagcggctttgattattgggggcaggggaccctcgtaaccgtgagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1665 - DNA, 1521 bp, Artificial Sequence
  Synthetic Polynucleotide
atggccttaccagtgaccgccttgctcctgccgctggccttgctgctccacgccgccaggccggacttcgtgatgacacagagccctctgagcctgcctgtgacacctggcgaacctgccagcatcagctgtagaagcagccagagcatcgtgcacagcaacggcaacacctacctggaatggtatctccagaagcctggacagagcccacagctgctgatctacaaggtgtccaacagattcagcggcgtgcccgacagattttctggcagcggctctggcaccgacttcaccctgaagattagcagagtggaagccgaggacgtgggcgtgtactactgcttccaaggctctcacgtgcccctgacctttggacagggcaccaagctggaaatcaagagaggcggaggcggaagtggaggcggaggatctggcggcggaggctctgaagtgcagctggttgaaagcggagccgaagtgaagaaacctggggcctctgtgaaggtgtcctgcaaggccagcggctacacctttaccagctactggattcactgggtccgacaggcccctggacaaggacttgagtggatgggcgagaacgacccctccaacggcaggaccaactacaacgagaagttcaagaaccgcgtgaccctgaccgtggacaccagcatctctaccgcctacatggaactgagccggctgagatccgatgacaccgccgtgtactattgcgccagaggacccaactacttttacagcatggactactggggccagggcacaatggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1666 - DNA, 1512 bp, Artificial Sequence
  Synthetic Polynucleotide
atggccttaccagtgaccgccttgctcctgccgctggccttgctgctccacgccgccaggccggagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggcggaggcggaagtggaggcggaggatctggcggcggaggctctcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1667 - DNA, 1512 bp, Artificial Sequence
  Synthetic Polynucleotide
atggccttaccagtgaccgccttgctcctgccgctggccttgctgctccacgccgccaggccgcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggcggaggcggaagtggaggcggaggatctggcggcggaggctctgagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1668 - DNA, 1530 bp, Artificial Sequence
  Synthetic Polynucleotide
atggccttaccagtgaccgccttgctcctgccgctggccttgctgctccacgccgccaggccggacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggcggaggcggaagtggaggcggaggatctggcggcggaggctctcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1669 - DNA, 1530 bp, Artificial Sequence
  Synthetic Polynucleotide
atggccttaccagtgaccgccttgctcctgccgctggccttgctgctccacgccgccaggccgcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggcggaggcggaagtggaggcggaggatctggcggcggaggctctgacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1670 - DNA, 1500 bp, Artificial Sequence
  Synthetic Polynucleotide
atggccttaccagtgaccgccttgctcctgccgctggccttgctgctccacgccgccaggccggacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggcggaggcggaagtggaggcggaggatctggcggcggaggctctcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1671 - DNA, 1500 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggcggaggcggaagtggaggcggaggatctggcggcggaggctctgacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1672 - DNA, 1477 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1673 - DNA, 1477 bp, Artificial Sequence; identical to SEQ ID NO: 1672
  Synthetic Polynucleotide

SEQ ID NO: 1674 - DNA, 1489 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1675 - DNA, 1489 bp, Artificial Sequence; identical to SEQ ID NO: 1674
  Synthetic Polynucleotide

SEQ ID NO: 1676 - DNA, 1515 bp, Artificial Sequence
  Synthetic Polynucleotide
atggccttaccagtgaccgccttgctcctgccgctggccttgctgctccacgccgccaggccggacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggcggaggcggaagtggaggcggaggatctggcggcggaggctctcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1677 - DNA, 1515 bp, Artificial Sequence
  Synthetic Polynucleotide
atggccttaccagtgaccgccttgctcctgccgctggccttgctgctccacgccgccaggccgcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggcggaggcggaagtggaggcggaggatctggcggcggaggctctgacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1678 - DNA, 1524 bp, Artificial Sequence
  Synthetic Polynucleotide
atggccttaccagtgaccgccttgctcctgccgctggccttgctgctccacgccgccaggccgcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggcggaggcggaagtggaggcggaggatctggcggcggaggctctcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1679 - DNA, 1524 bp, Artificial Sequence
  Synthetic Polynucleotide
atggccttaccagtgaccgccttgctcctgccgctggccttgctgctccacgccgccaggccgcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggcggaggcggaagtggaggcggaggatctggcggcggaggctctcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1680 - DNA, 1500 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggcggaggcggaagtggaggcggaggatctggcggcggaggctctcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1681 - DNA, 1500 bp, Artificial Sequence
  Synthetic Polynucleotide
atggccttaccagtgaccgccttgctcctgccgctggccttgctgctccacgccgccaggccgcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggcggaggcggaagtggaggcggaggatctggcggcggaggctctgacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1682 - DNA, 1524 bp, Artificial Sequence
  Synthetic Polynucleotide
atggccttaccagtgaccgccttgctcctgccgctggccttgctgctccacgccgccaggccggacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggcggaggcggaagtggaggcggaggatctggcggcggaggctctcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1683 - DNA, 1524 bp, Artificial Sequence
  Synthetic Polynucleotide
atggccttaccagtgaccgccttgctcctgccgctggccttgctgctccacgccgccaggccgcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggcggaggcggaagtggaggcggaggatctggcggcggaggctctgacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1684 - DNA, 1509 bp, Artificial Sequence
  Synthetic Polynucleotide
atggccttaccagtgaccgccttgctcctgccgctggccttgctgctccacgccgccaggccggacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggcggaggcggaagtggaggcggaggatctggcggcggaggctctgaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1685 - DNA, 1509 bp, Artificial Sequence
  Synthetic Polynucleotide
atggccttaccagtgaccgccttgctcctgccgctggccttgctgctccacgccgccaggccggaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggcggaggcggaagtggaggcggaggatctggcggcggaggctctgacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1686 - DNA, 1500 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1687 - DNA, 1500 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggcggaggcggaagtggaggcggaggatctggcggcggaggctctgacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1688 - DNA, 1500 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggcggaggcggaagtggaggcggaggatctggcggcggaggctctgaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1689 - DNA, 1500 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggcggaggcggaagtggaggcggaggatctggcggcggaggctctgacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1690 - DNA, 1524 bp, Artificial Sequence
  Synthetic Polynucleotide
atggccttaccagtgaccgccttgctcctgccgctggccttgctgctccacgccgccaggccgcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggcggaggcggaagtggaggcggaggatctggcggcggaggctctcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1691 - DNA, 1524 bp, Artificial Sequence
  Synthetic Polynucleotide
atggccttaccagtgaccgccttgctcctgccgctggccttgctgctccacgccgccaggccgcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggcggaggcggaagtggaggcggaggatctggcggcggaggctctcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1692 - DNA, 1545 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggcggaggcggaagtggaggcggaggatctggcggcggaggctctgaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1693 - DNA, 1545 bp, Artificial Sequence
  Synthetic Polynucleotide
atggccttaccagtgaccgccttgctcctgccgctggccttgctgctccacgccgccaggccggaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggcggaggcggaagtggaggcggaggatctggcggcggaggctctgacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1694 - DNA, 1461 bp, Artificial Sequence
  Synthetic Polynucleotide
atggccttaccagtgaccgccttgctcctgccgctggccttgctgctccacgccgccaggccggtcgtgatgacccagacccctctgagcctgagcgtgacactgggacagcctgccagcatcagctgcaagagcagccagagcctgctgcacagcgacggcaagacctacctgaactggctgcagcagaggccaggccagagccctcggagactgatctacctggtgtccaagctggacagcggcgtgcccgatagattttccggctctggcagcggcaccgacttcaccctgaagatcagccgggtggaagccgaggacgtgggcatctactactgttggcagggcacccacctgtggacctttggcggcggaacaaaggtggaaatcaagggcggaggcggaagtggaggcggaggatctggcggcggaggctctgaagtgcacctggtggaaagcggcggaggactggtgcagccagggggatctctgagactgtcttgtgccgccagcggcttcaccttcagcagatacggcatgagctgggtgcgccaggcccctggaaaaggactggaactggtggctatgatgaagaccaagggcggcagaacctactaccccgacagcgtgaagggccggttcaccatctcccgggacaacgccaagaacagcctgtacctgcagatgaactccctgcgggccgaggacaccgccatctactattgtgcctccgacggctactactggggccagggaacaaccgtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1695 - DNA, 1470 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagcgccaccagcagcgtgtcctacatgcactggtatcagcagaagcccggcaaggcccctaagcggtggatctacgataccagcaaactggcctctggcgtgcccagcagattttctggctctggcagcggcaccgagttcaccctgacaatatctagcctccagcctgaggacttcgccacctactactgccagcagtggtccagcaatcccctgacctttggacagggcaccaagctggaaatcaaaggcggaggcggaagtggaggcggaggatctggcggcggaggctctcaagttcagctggttcagtctggggccgaagtgaagaaacctggggcctctgtgaaggtgtcctgcaaggccagcggctacaagttcaccagctacgtgatgcactgggtccgacaggctccaggacaaggactggaatggatcggctacatcaacccctacaacgacgtgaccaagtacaacgagaagttcaagggcagagtgaccatcaccgccgacaagagcacaagcaccgcctacatggaactgagcagcctgagaagcgaggacaccgccgtgcactattgtgccagaggcagctactacgactacgacggctttgtgtattggggccagggcaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1696 - DNA, 1485 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagagcctgctgaacagccggaccagaaagaactacctggcctggtatcagcagaagcccggacagtctcccaagctgctgatctactggaccagcaccagaaagtccggcgtgcccgatagattttctggctctggcagcggcaccgacttcaccctgacaatttctagcctgcaagccgaggacgtggccgtgtactactgcaagcagagcttcatcctgcggacctttggccagggcaccaaggtggaaatcaaaggcggaggcggaagtggaggcggaggatctggcggcggaggctctgaagttcagctggttcagagcggagccgaagtgaagaaacctggggcctctgtgaaggtgtcctgcaaggcttccggcttcaccttcaccagctactacatccactgggtccgacaggcccctggacaaggactggaatggatcggctggatctaccccgagaacgacaacaccaagtacaacgagaagttcaaggaccgcgtgaccatcaccgccgataccagcacaagcaccgcctacctggaactgagcagcctgagaagcgaggacaccgccgtgtattattgcgccagagatgcctacagccggtactacttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1697 - DNA, 1494 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagactgctgagcagctacggccacacatacctgcactggtatctccagaagcctggacagagcccacagctgctgatctacgaggtgtccaacagattcagcggcgtgcccgatagattttccggctctggcagcggcaccgacttcaccctgaagattagcagagtggaagccgaggacgtgggcgtgtactactgtagccagagcacacacgtgcccctgacctttggacagggcaccaaggtggaaatcaaaggcggaggcggaagtggaggcggaggatctggcggcggaggctctgaagtgcagctggttgaatctggcggcggactggttaagcctggcggatctctgagactgagctgtgccgccagcggctacaccttcagcaattactggatcggctgggtccgacaggcccctggaaaaggactggaatggatcggcgacatctaccctggcggcaactacatcagaaacaacgagaagttcaaggacaagaccacactgagcgccgacaccagcaagaacacagcctacctccagatgaacagcctgaaaaccgaggacaccgccgtgtactattgcggcagcagcttcggcagcaactacgtgttcgcctggttcacctattggggccagggcacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1698 - DNA, 1488 bp, Artificial Sequence
  Synthetic Polynucleotide
atggccttaccagtgaccgccttgctcctgccgctggccttgctgctccacgccgccaggccggacatcgtgatgtctcagagccctagcagcctggctgtgtccgctggcgagaaagtgaccatgagctgcaagagcagccagagcctgttcaacagccggaccagaaagaactacctggcctggtatcagcagaagcccggacagtctcccaagctgctgatctactgggccagcgccagagatagcggagtgcctgctagattcacaggcagcggcagcgagacatacttcaccctgaccatcagcagagtgcaggccgaggatctggccgtgtactactgtatgcagagcttcaacctgcggaccttcggcggaggcaccaagctggaaatcaaaggcggaggcggaagtggaggcggaggatctggcggcggaggctctgaagtgaacctggttgaatccggcggaggactggttcagcctggcggatctctgagactgagctgtgccaccagcggcttcaccttcaccgacaactacatgagctgggtccgacagcctcctggcaaagctctggaatggctgggcttcatcagaaacaaggccaacggctacaccaccgactacagcgcctctgtgcggggcagattcaccatctccagagacaacagccagtccatcctgtacctccagatgaacgccctgagagccgaggatagcgccacctactactgtgccagagatgtgggcagcaactacttcgactattggggccagggcaccacactgaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1699 - DNA, 1491 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctcggcgagcgcgtgacaatgaattgcaagagcagccagagcctgctgtactccaccaaccagaagaactacctggcctggtatcagcagaagcccggacagtctcccaagctgctgatctactgggccagcaccagagaaagcggcgtgcccgatagattttctggctctggcagcggcaccgacttcaccctgacaatcagttctgtgcaggccgaggacgtggccgtgtactactgccagcagtattacagctaccggaccttcggcggaggcaccaagctggaaatcaaaggcggaggcggaagtggaggcggaggatctggcggcggaggctctcaagttcagctccagcagtctggccccgagtggaaacctggcgcttctgtgaagatgagctgcaaggccagcggctacaccttcaccagctacgtgatccactgggtccgacagaagcctggccaaggactggattggatcggctacatcaacccctacaacgacggcaccgattacgacgagaagttcaagggcaaagccacactgaccagcgacaccagcacaagcaccgcctacatggaactgagcagcctgagaagcgaggacaccgccgtgtattattgcgccagagagaaggacaactacgccaccggcgcttggtttgcctattggggccagggaacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1700 - DNA, 1479 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatcagaaactacctgaactggtatcagcagaagcccggcaaggcccctaagctgctgatctactacaccagcagactggaaagcggcgtgcccagcagattttctggcagcggctctggcaccgactacaccctgacaatatccagcctccagcctgaggacttcgccacctactattgccagcagggcaacaccctgccttggacatttggccagggcaccaaggtggaaatcaaaggcggaggcggaagtggaggcggaggatctggcggcggaggctctgaagtgcagctggttgaatcaggtggcggcctggttcaacctggcggatctctgagactgagctgtgccgccagcggctacagctttaccggctacaccatgaactgggtccgacaggcccctggcaaaggactggaatgggtcgccctgattaacccctacaagggcgtgtccacctacaaccagaagttcaaggacaggttcaccatcagcgtggacaagagcaagaacaccgcctacctccagatgaactccctgagagccgaggacaccgccgtgtactattgtgccagaagcggctactacggcgacagcgactggtactttgatgtgtggggccagggaaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1701 - DNA, 1485 bp, Artificial Sequence
  Synthetic Polynucleotide
atggccttaccagtgaccgccttgctcctgccgctggccttgctgctccacgccgccaggccgagcacaggatctcaggtgcagctccagcagtctggccctgagcttgtgaaacctggcgcttccgtgaagatgagctgcaaggccagcggctacaccttcaccgactatgtgattaactggggcaagcagcggagcggccaaggactggaatggatcggcgaaatctaccctggcagcggcaccaactactacaacgagaagttcaaggccaaggccacactgaccgccgacaagagcagcaatatcgcctacatgcagctgagcagcctgaccagcgaagatagcgccgtgtacttctgcgccagaagaggcagatacggcctgtacgctatggactattggggccagggcaccagcgtgacagtgtcatctggcggaggcggaagtggaggcggaggatctggcggcggaggctctgacatccagatgacccagacaaccagcagcctgtctgccagcctgggcgatagagtgaccatcagctgtagagccagccaggacatcagcaactacctgaactggtatcagcagaaacccgacggcaccgtgaagctgctgatctactacaccagcagactgcacagcggcgtgcccagcagattttctggctctggaagcggcacagattactccctgaccatcaacaacctggaacaagaggacattgccacctacttttgccagcaaggcaacacccggccttggacatttggcggaggcaccaagctggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1702 - DNA, 1470 bp, Artificial Sequence
  Synthetic Polynucleotide
atggccttaccagtgaccgccttgctcctgccgctggccttgctgctccacgccgccaggccgcagatcgtgctgacacagagccctgccatcatgagcgcttccccaggcgagaaagtgaccatgacctgtagcgccacaagcagcgtgtcctacatgcactggtatcagcagaagtccggcacaagccccaagcggtggatctacgataccagcaaactggcctctggcgtgcccgctagattttctggctctggcagcggcaccagctacagcctgacaatcagcagcatggaagccgaggatgccgccacctactactgccagcagtggtccagcaatcccctgacatttggagccggcaccaagctggaactgaaaggcggaggcggaagtggaggcggaggatctggcggcggaggctctgaagttcagctccagcagtctggccccgagcttgtgaaacctggcgcttccgtgaagatgagctgcaaggccagcggctacaagttcacctcctacgtgatgcactgggtcaagcagaaacccggccagggccttgagtggatcggctacatcaacccctacaacgacgtgaccaagtacaacgagaagttcaagggcaaagccacactgaccagcgacaagagcagcagcaccgcctacatggaactgagcagcctgacctctgaggacagcgccgtgcactattgtgccagaggcagctactacgactacgacggctttgtgtattggggccagggcaccctggttaccgtttctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1703 - DNA, 1473 bp, Artificial Sequence
  Synthetic Polynucleotide
atggccttaccagtgaccgccttgctcctgccgctggccttgctgctccacgccgccaggccggacatccagatgacacagagccctgccagccagtctgcctctctgggagagtctgtgaccatcacctgtctggcctctcagaccatcggaacatggctggcctggtatcagcagaagcctggcaagtctccccagctgctgatctacgccgctacatctctggctgatggcgtgcccagcagattttctggcagcggctccggcaccaagttcagcctgaagatcagaaccctccaggccgaggacttcgtgtcctactattgccagcagctgtactccaagccttacacctttggcggaggcaccaagctggaaatcaagagaggcggaggcggaagtggaggcggaggatctggcggcggaggctctgaagttcagctgcaacagagcggagccgagctggttaagcctggcgcttctgtgaagctgagctgtacccctagcggcttcaacgtgaaggacacctacatccactgggtcaagcagcggcctaagcagggcctcgaatggatcggaagaatcgaccctagcgacggcgacattaagtacgaccccaagttccagggcaaagccaccatcaccgccgacaccagcagcaacacagtgtctctccagctgagcagcctgaccagcgaagataccgccgtgtactattgcgcccgttggttcggcgattacggggccatgaattattggggccagggcaccagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1704 - DNA, 1020 bp, Artificial Sequence
  Synthetic Polynucleotide
atggccttaccagtgaccgccttgctcctgccgctggccttgctgctccacgccgccaggccggacatcgtgctgacacagagccctgcttccctggccgtgtccctgggacagagagccaccatctcttgcagagccagcgagagcgtggacgactacggcatcagcttcatgaactggttccagcagaagcccggccagccccccaagctgctgatctatgccgcccctaatcagggcagcggcgtgccagccagattttctggcagcggctccggcaccgacttcagcctgaacatccaccctatggaagaggacgacaccgccatgtacttttgccagcagagcaaggacgtgcggtggcggcatcaggctggcgatcagacaggcggaggcggaagtggaggcggaggatctggcggcggaggctctgaagtgaagctggtggaatccggcggagggctggtgcagcctggcggatctctgaagctgagctgtgccgccagcggcttcgacttctcccggtactggatgagctgggtgcgccaggcccctggcaaaggactggaatggatcggcgagatcaacctggacagcagcaccatcaactacacccccagcctgaaggacaagttcatcatcagccgggacaacgccaagaacaccctgtacctccagatgagcaaagtgcggagcgaggataccgccctgtactactgcgctcggagatacgacgctatggactactggggccagggcaccagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1705 - DNA, 1029 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1706 - DNA, 1029 bp, Artificial Sequence
  Synthetic Polynucleotide
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1707 - DNA, 1029 bp, Artificial Sequence
  Synthetic Polynucleotide
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1708 - DNA, 1032 bp, Artificial Sequence
  Synthetic Polynucleotide
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1709 - DNA, 1053 bp, Artificial Sequence
  Synthetic Polynucleotide
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1710 - DNA, 1104 bp, Artificial Sequence
  Synthetic Polynucleotide
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1711 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1712 - DNA, 1032 bp, Artificial Sequence
  Synthetic Polynucleotide
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1713 - DNA, 1050 bp, Artificial Sequence
  Synthetic Polynucleotide
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1714 - DNA, 1065 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1715 - DNA, 1026 bp, Artificial Sequence
  Synthetic Polynucleotide
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1716 - DNA, 1056 bp, Artificial Sequence
  Synthetic Polynucleotide
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1717 - DNA, 1029 bp, Artificial Sequence
  Synthetic Polynucleotide
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1718 - DNA, 1041 bp, Artificial Sequence
  Synthetic Polynucleotide
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1719 - DNA, 1035 bp, Artificial Sequence
  Synthetic Polynucleotide
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1720 - DNA, 1035 bp, Artificial Sequence
  Synthetic Polynucleotide
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1721 - DNA, 1038 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1722 - DNA, 1032 bp, Artificial Sequence
  Synthetic Polynucleotide
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1723 - DNA, 1065 bp, Artificial Sequence
  Synthetic Polynucleotide
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1724 - DNA, 1032 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1725 - DNA, 1035 bp, Artificial Sequence
  Synthetic Polynucleotide
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1726 - DNA, 1038 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1727 - DNA, 1038 bp, Artificial Sequence
  Synthetic Polynucleotide
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1728 - DNA, 1038 bp, Artificial Sequence; identical to SEQ ID NO: 1727
  Synthetic Polynucleotide

SEQ ID NO: 1729 - DNA, 1038 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1730 - DNA, 1044 bp, Artificial Sequence
  Synthetic Polynucleotide
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1731 - DNA, 1035 bp, Artificial Sequence
  Synthetic Polynucleotide
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1732 - DNA, 1044 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1733 - DNA, 1038 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1734 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1735 - DNA, 1065 bp, Artificial Sequence
  Synthetic Polynucleotide
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1736 - DNA, 1041 bp, Artificial Sequence
  Synthetic Polynucleotide
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1737 - DNA, 1035 bp, Artificial Sequence; identical to SEQ ID NO: 1734
  Synthetic Polynucleotide

SEQ ID NO: 1738 - DNA, 1032 bp, Artificial Sequence
  Synthetic Polynucleotide
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1739 - DNA, 1038 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1740 - DNA, 1032 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1741 - DNA, 1047 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1742 - DNA, 1023 bp, Artificial Sequence
  Synthetic Polynucleotide
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1743 - DNA, 1041 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1744 - DNA, 1041 bp, Artificial Sequence
  Synthetic Polynucleotide
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1745 - DNA, 1020 bp, Artificial Sequence
  Synthetic Polynucleotide
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1746 - DNA, 1035 bp, Artificial Sequence
  Synthetic Polynucleotide
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1747 - DNA, 1026 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1748 - DNA, 1056 bp, Artificial Sequence
  Synthetic Polynucleotide
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1749 - DNA, 1044 bp, Artificial Sequence
  Synthetic Polynucleotide
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1750 - DNA, 1122 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1751 - DNA, 1119 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1752 - DNA, 1167 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1753 - DNA, 1035 bp, Artificial Sequence
  Synthetic Polynucleotide
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1754 - DNA, 1032 bp, Artificial Sequence
  Synthetic Polynucleotide
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1755 - DNA, 1023 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1756 - DNA, 1053 bp, Artificial Sequence
  Synthetic Polynucleotide
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1757 - DNA, 1014 bp, Artificial Sequence
  Synthetic Polynucleotide
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1758 - DNA, 1038 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1759 - DNA, 1026 bp, Artificial Sequence
  Synthetic Polynucleotide
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1760 - DNA, 1038 bp, Artificial Sequence
  Synthetic Polynucleotide
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1761 - DNA, 1026 bp, Artificial Sequence
  Synthetic Polynucleotide
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1762 - DNA, 1050 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1763 - DNA, 1035 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1764 - DNA, 1047 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1765 - DNA, 1047 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1766 - DNA, 1029 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1767 - DNA, 1035 bp, Artificial Sequence
  Synthetic Polynucleotide
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1768 - DNA, 1026 bp, Artificial Sequence
  Synthetic Polynucleotide
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1769 - DNA, 1029 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1770 - DNA, 1017 bp, Artificial Sequence
  Synthetic Polynucleotide
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1771 - DNA, 1110 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1772 - DNA, 1023 bp, Artificial Sequence
  Synthetic Polynucleotide
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1773 - DNA, 1050 bp, Artificial Sequence
  Synthetic Polynucleotide
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1774 - DNA, 1062 bp, Artificial Sequence
  Synthetic Polynucleotide
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1775 - DNA, 1035 bp, Artificial Sequence
  Synthetic Polynucleotide
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1776 - DNA, 1020 bp, Artificial Sequence
  Synthetic Polynucleotide
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1777 - DNA, 1029 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1778 - DNA, 1014 bp, Artificial Sequence
  Synthetic Polynucleotide
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1779 - DNA, 1044 bp, Artificial Sequence
  Synthetic Polynucleotide
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1780 - DNA, 1020 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1781 - DNA, 1029 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1782 - DNA, 1059 bp, Artificial Sequence
  Synthetic Polynucleotide
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1783 - DNA, 1050 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1784 - DNA, 1026 bp, Artificial Sequence
  Synthetic Polynucleotide
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1785 - DNA, 1005 bp, Artificial Sequence
  Synthetic Polynucleotide
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1786 - DNA, 1020 bp, Artificial Sequence
  Synthetic Polynucleotide
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1787 - DNA, 1029 bp, Artificial Sequence
  Synthetic Polynucleotide
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1788 - DNA, 1044 bp, Artificial Sequence
  Synthetic Polynucleotide
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1789 - DNA, 1029 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1790 - DNA, 1047 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1791 - DNA, 1041 bp, Artificial Sequence
  Synthetic Polynucleotide
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1792 - DNA, 1041 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1793 - DNA, 1035 bp, Artificial Sequence
  Synthetic Polynucleotide
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1794 - DNA, 1026 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1795 - DNA, 1029 bp, Artificial Sequence
  Synthetic Polynucleotide
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1796 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1797 - DNA, 1038 bp, Artificial Sequence
  Synthetic Polynucleotide
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1798 - DNA, 1038 bp, Artificial Sequence
  Synthetic Polynucleotide
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1799 - DNA, 1038 bp, Artificial Sequence
  Synthetic Polynucleotide
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1800 - DNA, 1032 bp, Artificial Sequence
  Synthetic Polynucleotide
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1801 - DNA, 1032 bp, Artificial Sequence
  Synthetic Polynucleotide
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1802 - DNA, 1047 bp, Artificial Sequence
  Synthetic Polynucleotide
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1803 - DNA, 1047 bp, Artificial Sequence
  Synthetic Polynucleotide
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1804 - DNA, 1041 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1805 - DNA, 1026 bp, Artificial Sequence
  Synthetic Polynucleotide
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1806 - DNA, 1011 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1807 - DNA, 1029 bp, Artificial Sequence
  Synthetic Polynucleotide
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1808 - DNA, 1050 bp, Artificial Sequence
  Synthetic Polynucleotide
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1809 - DNA, 1053 bp, Artificial Sequence
  Synthetic Polynucleotide
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1810 - DNA, 1044 bp, Artificial Sequence
  Synthetic Polynucleotide
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1811 - DNA, 1035 bp, Artificial Sequence
  Synthetic Polynucleotide
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1812 - DNA, 1068 bp, Artificial Sequence
  Synthetic Polynucleotide
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1813 - DNA, 1056 bp, Artificial Sequence
  Synthetic Polynucleotide
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1814 - DNA, 1038 bp, Artificial Sequence
  Synthetic Polynucleotide
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1815 - DNA, 1029 bp, Artificial Sequence
  Synthetic Polynucleotide
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1816 - DNA, 1023 bp, Artificial Sequence
  Synthetic Polynucleotide
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1817 - DNA, 1029 bp, Artificial Sequence
  Synthetic Polynucleotide
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1818 - DNA, 1035 bp, Artificial Sequence
  Synthetic Polynucleotide
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1819 - DNA, 1050 bp, Artificial Sequence
  Synthetic Polynucleotide
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1820 - DNA, 1032 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1821 - DNA, 1035 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1822 - DNA, 1032 bp, Artificial Sequence
  Synthetic Polynucleotide
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1823 - DNA, 1029 bp, Artificial Sequence
  Synthetic Polynucleotide
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1824 - DNA, 1029 bp, Artificial Sequence
  Synthetic Polynucleotide
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1825 - DNA, 1035 bp, Artificial Sequence
  Synthetic Polynucleotide
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1826 - DNA, 1029 bp, Artificial Sequence
  Synthetic Polynucleotide
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1827 - DNA, 1026 bp, Artificial Sequence
  Synthetic Polynucleotide
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1828 - DNA, 1026 bp, Artificial Sequence
  Synthetic Polynucleotide
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1829 - DNA, 1050 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1830 - DNA, 1068 bp, Artificial Sequence
  Synthetic Polynucleotide
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1831 - DNA, 1023 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1832 - DNA, 1053 bp, Artificial Sequence
  Synthetic Polynucleotide
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1833 - DNA, 1041 bp, Artificial Sequence
  Synthetic Polynucleotide
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1834 - DNA, 993 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1835 - DNA, 1023 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1836 - DNA, 1035 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1837 - DNA, 1023 bp, Artificial Sequence
  Synthetic Polynucleotide
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1838 - DNA, 1026 bp, Artificial Sequence
  Synthetic Polynucleotide
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1839 - DNA, 1041 bp, Artificial Sequence
  Synthetic Polynucleotide
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1840 - DNA, 1023 bp, Artificial Sequence
  Synthetic Polynucleotide
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1841 - DNA, 1026 bp, Artificial Sequence
  Synthetic Polynucleotide
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1842 - DNA, 1050 bp, Artificial Sequence
  Synthetic Polynucleotide
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1843 - DNA, 1038 bp, Artificial Sequence; identical to SEQ ID NO: 1760
  Synthetic Polynucleotide

SEQ ID NO: 1844 - DNA, 1029 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1845 - DNA, 1029 bp, Artificial Sequence
  Synthetic Polynucleotide
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1846 - DNA, 1026 bp, Artificial Sequence
  Synthetic Polynucleotide
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1847 - DNA, 1023 bp, Artificial Sequence
  Synthetic Polynucleotide
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1848 - DNA, 1026 bp, Artificial Sequence
  Synthetic Polynucleotide
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1849 - DNA, 1038 bp, Artificial Sequence
  Synthetic Polynucleotide
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1850 - DNA, 1047 bp, Artificial Sequence
  Synthetic Polynucleotide
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1851 - DNA, 1053 bp, Artificial Sequence
  Synthetic Polynucleotide
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1852 - DNA, 1050 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1853 - DNA, 1020 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1854 - DNA, 1026 bp, Artificial Sequence
  Synthetic Polynucleotide
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1855 - DNA, 1026 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1856 - DNA, 1029 bp, Artificial Sequence
  Synthetic Polynucleotide
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1857 - DNA, 1023 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1858 - DNA, 1080 bp, Artificial Sequence
  Synthetic Polynucleotide
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1859 - DNA, 1071 bp, Artificial Sequence
  Synthetic Polynucleotide
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1860 - DNA, 993 bp, Artificial Sequence
  Synthetic Polynucleotide
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1861 - DNA, 1041 bp, Artificial Sequence
  Synthetic Polynucleotide
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1862 - DNA, 1014 bp, Artificial Sequence
  Synthetic Polynucleotide
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1863 - DNA, 1017 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1864 - DNA, 1017 bp, Artificial Sequence
  Synthetic Polynucleotide
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1865 - DNA, 1050 bp, Artificial Sequence
  Synthetic Polynucleotide
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1866 - DNA, 1038 bp, Artificial Sequence
  Synthetic Polynucleotide
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1867 - DNA, 1023 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1868 - DNA, 1035 bp, Artificial Sequence
  Synthetic Polynucleotide
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1869 - DNA, 1062 bp, Artificial Sequence
  Synthetic Polynucleotide
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1870 - DNA, 1035 bp, Artificial Sequence
  Synthetic Polynucleotide
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1871 - DNA, 1044 bp, Artificial Sequence
  Synthetic Polynucleotide
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1872 - DNA, 1029 bp, Artificial Sequence
  Synthetic Polynucleotide
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1873 - DNA, 1032 bp, Artificial Sequence
  Synthetic Polynucleotide
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1874 - DNA, 1023 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1875 - DNA, 1059 bp, Artificial Sequence
  Synthetic Polynucleotide
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1876 - DNA, 1029 bp, Artificial Sequence
  Synthetic Polynucleotide
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1877 - DNA, 1020 bp, Artificial Sequence
  Synthetic Polynucleotide
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1878 - DNA, 1035 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1879 - DNA, 1032 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1880 - DNA, 1038 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1881 - DNA, 1026 bp, Artificial Sequence
  Synthetic Polynucleotide
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1882 - DNA, 1020 bp, Artificial Sequence
  Synthetic Polynucleotide
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1883 - DNA, 1053 bp, Artificial Sequence
  Synthetic Polynucleotide
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1884 - DNA, 1038 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1885 - DNA, 1041 bp, Artificial Sequence
  Synthetic Polynucleotide
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1886 - DNA, 1041 bp, Artificial Sequence
  Synthetic Polynucleotide
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1887 - DNA, 1077 bp, Artificial Sequence
  Synthetic Polynucleotide
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1888 - DNA, 1059 bp, Artificial Sequence
  Synthetic Polynucleotide
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1889 - DNA, 1029 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1890 - DNA, 1026 bp, Artificial Sequence
  Synthetic Polynucleotide
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1891 - DNA, 1032 bp, Artificial Sequence
  Synthetic Polynucleotide
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1892 - DNA, 1005 bp, Artificial Sequence
  Synthetic Polynucleotide
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1893 - DNA, 1014 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1894 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1895 - DNA, 1023 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1896 - DNA, 1026 bp, Artificial Sequence
  Synthetic Polynucleotide
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1897 - DNA, 1029 bp, Artificial Sequence
  Synthetic Polynucleotide
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1898 - DNA, 1044 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1899 - DNA, 1068 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1900 - DNA, 1050 bp, Artificial Sequence
  Synthetic Polynucleotide
atggccttaccagtgaccgccttgctcctgccgctggccttgctgctccacgccgccaggccggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacgccgcctaccctacttttggcggagggaccaaggttgagatcaaacggggcggaggcggaagtggaggcggaggatctggcggcggaggctctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggcggtgtactactgcgccagagagagttggccaatggacgtatggggccagggaacaactgtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1901 - DNA, 1065 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaaaggcggaggcggaagtggaggcggaggatctggcggcggaggctctcaaatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1902 - DNA, 1056 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagaatctcctggcctttcacttttggcggagggaccaaggttgagatcaaaggcggaggcggaagtggaggcggaggatctggcggcggaggctctgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggcggtgtactactgcgcaagagccgagatgggagccgtattcgacatatggggtcagggtacaatggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1903 - DNA, 1071 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagacacgtctggcctcctacttttggcggagggaccaaggttgagatcaaacggggcggaggcggaagtggaggcggaggatctggcggcggaggctctcagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagaggcaggggatatgcaaccagcttagccttcgatatctggggtcagggtacaatggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1904 - DNA, 1086 bp, Artificial Sequence
  Synthetic Polynucleotide
atggccttaccagtgaccgccttgctcctgccgctggccttgctgctccacgccgccaggccggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagggactcggcctccctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgccagagacggtacttatctaggtggtctctggtacttcgacttatgggggagaggtaccttggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1905 - DNA, 1101 bp, Artificial Sequence
  Synthetic Polynucleotide
atggccttaccagtgaccgccttgctcctgccgctggccttgctgctccacgccgccaggccggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgcccacactcctttcacttttggcggagggaccaaggttgagatcaaacggggcggaggcggaagtggaggcggaggatctggcggcggaggctctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagaactcctgaatactcctccagcatatggcactattactacggcatggacgtatggggccagggaacaactgtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1906 - DNA, 1074 bp, Artificial Sequence
  Synthetic Polynucleotide
atggccttaccagtgaccgccttgctcctgccgctggccttgctgctccacgccgccaggccggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatagcgcatccaccagggccactggtatcccagccaggttcagtggcagtgggtctgggacagagttcactctcaccatcagcagcctgcagtctgaagattttgcagtttattactgtcagcagcaccacgtctggcctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgtcaaggggccgttgcaggagccgccatacgattatggaatggacgtatggggccagggaacaactgtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1907 - DNA, 1062 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattctactacccttggacttttggcggagggaccaaggttgagatcaaacggggcggaggcggaagtggaggcggaggatctggcggcggaggctctgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcaaccattagtagtagtagtagtaccatatactacgcagactctgtgaagggccgattcaccatctccagagacaatgccaagaactcactgtatctgcaaatgaacagcctgagagctgaggacacggcggtgtactactgcgccagaggttctcaggagcacctgattttcgattattggggacagggtacattggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1908 - DNA, 1077 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtaccgccagcagcagagtgtccagcagctacctgcactggttccagcagaagcctggcaaggcccctaagctgctgatctacagcaccagcaatctggcctctggcgtgcccagcagattttctggctctggcagcggcaccgacttcaccctgacaatatctagcctccagcctgaggacttcgccacctactactgccaccagtaccacagaagcccctacacattcggccagggcaccaaggtggaaatcaagagaggcggaggcggaagtggaggcggaggatctggcggcggaggctctgaagttcagctggttgaatctggcggcggactggttcaacctggcggatctctgagactgagctgtgccgcctctggctacgccttcagcaacagctggatcaactgggtccgacaggcccctggcaaaggactggaatgggtcggacaaatctaccccggcgactacgacaccaactacaacggcaagttcaagggcagattcaccatcagccgggacaagagcaagaacaccgcctacctccagatgaactccctgagagccgaggacaccgccgtgtactattgtgctagaggcggctccatctactacggcaacctgggcttcttcgacgtgtggggacagggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1909 - DNA, 1047 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgtagcgccagcagcagcgtgacctacatgtactggtatcagcagaagcccggcaaggcccctaagctgctgatctacgacaccagcaatctggcctctggcgtgcccagcagattttctggctctggcagcggcaccgactacaccctgacaatatctagcctccagcctgaggacttcgccacctactactgccagcagtggtccaactatcccctgacattcggccagggcaccaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacagcttcatcgagtacaccatcaactgggtccgacaggcccctggacaaggcctggaatggatcggcaacatcgacccctactacggcacaacctactacaaccagatgttcaccggcagagccacactgaccgtggacacctctatcagcaccgcctacatggaactgagccggctgagatccgatgacaccgccgtgtactattgtgccagaggcagcgcctggtttccctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1910 - DNA, 1047 bp, Artificial Sequence
  Synthetic Polynucleotide
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcgagaacatctacagctacctggcctggtatcagcagaagcctggcaaggcccctaagctgctgatctacaacaccaagacactcggcgagggcgtgcccagcagattttctggttctggcagcggcaccgacttcaccctgaccatatctagcctgcagcctgaggacttcgccacctactactgccagcaccactacggcacccctttcacatttggccctggcaccaaggtggacatcaaaggcggaggcggaagtggaggcggaggatctggcggcggaggctctcaagttcagctggttcagagcggagccgaagtgaagaaacctggggcctctgtgaaggtgtcctgcaaggccagcggctacaccttcagcgactattgggtgcactgggtccgacaggctccaggacaaggactggaatggatgggagccatcgacggcagcgataccttcaacgattacagccagaaattcaaaggccgcgtgaccatgaccagagacaccagcatcagcaccgcctacatggaactgagccggctgagatccgatgacaccgccgtgtactattgtgccagaggcggcctgctgcagtattggggacagggaacactggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1911 - DNA, 1059 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgcactggtatcagcagaagcccggacaggcccctagactgctgatctacgataccagcaagctggcctctgacatccccgccagattttctggcagcggctctggcaccgatttcaccctgaccataagcagcctggaacctgaggacttcgccgtgtactactgtcagcagggcagcgtgtaccccttcacatttggcggcggaacaaaggtggaaatcaaaggcggaggcggaagtggaggcggaggatctggcggcggaggctctcaagttcagctgcaagagtctggccctggcctggttaagcctagcggaacactgagcctgacctgtgctgtgtctggcggcagcatcagcacatctggcatgggcgttggctgggtccgacagcctcctggaaaaggcctggaatggatcggccacatttggtgggacgacgacaagcggtacaaccccgctctgaagtccagagtgaccatcagcgtggacaagagcaagaaccagttcagcctgcggctgagcagcgtgacagctgcagataccgccgtgtattattgcgcccggatggaactgtggtcctactacttcgactactggggcaagggcaccaccgtgactgtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1912 - DNA, 1071 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgacagagtgaccatctcttgtagagccagccaggacatcagcaactacctgaactggtatcagcagaaacccgacggcaccgtgaagctgctgatctactacaccagcatcctgcacagcggcgtgcccagcagattttctggctctggcagcggcaccgactacagcctgaccatcagcaatctggaacaagaggacttcgctacctacttctgccagcaaggcaacaccctgccttggacatttggcggaggcaccaagctggaaatcaaagctggcggaggcggaagtggaggcggaggatctggcggcggaggctctgaagtgcaactggttgaatctggcggcggactggttaagcctggcggatctctgaagctgagctgtgccgcctctggcttcgccttcagcatctacgatatgagctgggtccgacagacccctgagaagagactggaatgggtcgcctacatctctagcggcggagggacctactatcccgacacagtgaagggcagattcaccatctccagagacaacgccaagaacaccctgtacctccagatgagcagcctgaagtccgaggacaccgccatgtactactgcgccagacacagcggctatggcacacattggggagtgctgtttgcctactggggccagggaacactggtcacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1913 - DNA, 1071 bp, Artificial Sequence
  Synthetic Polynucleotide
atggccttaccagtgaccgccttgctcctgccgctggccttgctgctccacgccgccaggccggatattcaactgacacaatcccccagctcactcagcgccagcgtgggggacagggttagctttacctgtcaagcctctcaggatataaataactttctgaactggtatcaacagaagcctgggaaggcgcccaaactcctgatctatgatgcgtccaacctggaaactggcgtgccttcacgctttagcggctctggcagtggtacagacttcacttttaccatctcttcacttcagccggaggacatcgccacatattactgtcaacagtacggaaacttgccctttacttttggaggcggcaccaaagttgaaatcaaaagaggcggaggcggaagtggaggcggaggatctggcggcggaggctctcaggtccaactgcaagaaagcggacccggactggtgaagccttctgagacacttagtctgacgtgcacggtcagtggcggctccatctcctcctattattggtcatggatacgacaacccccaggtaagggcctggaatggattggctatatctactattcaggaagcacgaactacaatcccagcctgaagtcccgagtgacaatttcagtagataccagtaaaaaccagttcagtcttaaactgtcaagcgtgacagctgccgacaccgctgtgtattactgcgtctcactggtgtattgtggaggggattgttatagcgggttcgattattggggacagggaaccctggtgactgtatcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1914 - DNA, 1077 bp, Artificial Sequence
  Synthetic Polynucleotide
atggccttaccagtgaccgccttgctcctgccgctggccttgctgctccacgccgccaggccggatatccagctcactcaaagcccctctagtctctctgcctcagtgggggatcgggtcagttttacttgtcaagcttcacaggatatcaacaacttccttaattggtatcagcagaagccaggaaaagcacccaagctgctcatctatgatgcctcaaatttggagacgggtgttcccagtcgattctctgggtcagggtccgggaccgactttacgtttacgatctcctctctgcagcccgaagacatcgccacatactattgtcaacagtacggcaacttgcctttcacatttgggggcgggactaaggttgaaatcaagaggggcggaggcggaagtggaggcggaggatctggcggcggaggctctcaggtacagctgcaggaatctgggcccggacttgtcaagccaagtcagacactttctcttacatgtaccgtgagcggcggaagtataagcagtggaggcttttactggtcttggatacggcagcacccaggcaaaggcttggagtggattggatacattcatcattcaggatctacacactataatccatcccttaagtcccgggtcaccattagcattgatacgtctaagaatctgttcagtctcaggctgtcctccgtcactgctgccgacacagccgtgtactactgcgcctccttggtttactgcggaggcgactgttatagcggctttgattattgggggcaggggaccctcgtaaccgtgagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1915 - DNA, 1077 bp, Artificial Sequence
  Synthetic Polynucleotide
atggccttaccagtgaccgccttgctcctgccgctggccttgctgctccacgccgccaggccggacttcgtgatgacacagagccctctgagcctgcctgtgacacctggcgaacctgccagcatcagctgtagaagcagccagagcatcgtgcacagcaacggcaacacctacctggaatggtatctccagaagcctggacagagcccacagctgctgatctacaaggtgtccaacagattcagcggcgtgcccgacagattttctggcagcggctctggcaccgacttcaccctgaagattagcagagtggaagccgaggacgtgggcgtgtactactgcttccaaggctctcacgtgcccctgacctttggacagggcaccaagctggaaatcaagagaggcggaggcggaagtggaggcggaggatctggcggcggaggctctgaagtgcagctggttgaaagcggagccgaagtgaagaaacctggggcctctgtgaaggtgtcctgcaaggccagcggctacacctttaccagctactggattcactgggtccgacaggcccctggacaaggacttgagtggatgggcgagaacgacccctccaacggcaggaccaactacaacgagaagttcaagaaccgcgtgaccctgaccgtggacaccagcatctctaccgcctacatggaactgagccggctgagatccgatgacaccgccgtgtactattgcgccagaggacccaactacttttacagcatggactactggggccagggcacaatggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1916 - DNA, 1068 bp, Artificial Sequence
  Synthetic Polynucleotide
atggccttaccagtgaccgccttgctcctgccgctggccttgctgctccacgccgccaggccggagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggcggaggcggaagtggaggcggaggatctggcggcggaggctctcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1917 - DNA, 1068 bp, Artificial Sequence
  Synthetic Polynucleotide
atggccttaccagtgaccgccttgctcctgccgctggccttgctgctccacgccgccaggccgcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggcggaggcggaagtggaggcggaggatctggcggcggaggctctgagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1918 - DNA, 1086 bp, Artificial Sequence
  Synthetic Polynucleotide
atggccttaccagtgaccgccttgctcctgccgctggccttgctgctccacgccgccaggccggacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggcggaggcggaagtggaggcggaggatctggcggcggaggctctcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1919 - DNA, 1086 bp, Artificial Sequence
  Synthetic Polynucleotide
atggccttaccagtgaccgccttgctcctgccgctggccttgctgctccacgccgccaggccgcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggcggaggcggaagtggaggcggaggatctggcggcggaggctctgacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1920 - DNA, 1056 bp, Artificial Sequence
  Synthetic Polynucleotide
atggccttaccagtgaccgccttgctcctgccgctggccttgctgctccacgccgccaggccggacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggcggaggcggaagtggaggcggaggatctggcggcggaggctctcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1921 - DNA, 1056 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggcggaggcggaagtggaggcggaggatctggcggcggaggctctgacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1922 - DNA, 1033 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1923 - DNA, 1033 bp, Artificial Sequence; identical to SEQ ID NO: 1922
  Synthetic Polynucleotide

SEQ ID NO: 1924 - DNA, 1045 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1925 - DNA, 1045 bp, Artificial Sequence; identical to SEQ ID NO: 1924
  Synthetic Polynucleotide

SEQ ID NO: 1926 - DNA, 1071 bp, Artificial Sequence
  Synthetic Polynucleotide
atggccttaccagtgaccgccttgctcctgccgctggccttgctgctccacgccgccaggccggacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggcggaggcggaagtggaggcggaggatctggcggcggaggctctcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1927 - DNA, 1071 bp, Artificial Sequence
  Synthetic Polynucleotide
atggccttaccagtgaccgccttgctcctgccgctggccttgctgctccacgccgccaggccgcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggcggaggcggaagtggaggcggaggatctggcggcggaggctctgacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1928 - DNA, 1080 bp, Artificial Sequence
  Synthetic Polynucleotide
atggccttaccagtgaccgccttgctcctgccgctggccttgctgctccacgccgccaggccgcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggcggaggcggaagtggaggcggaggatctggcggcggaggctctcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1929 - DNA, 1080 bp, Artificial Sequence
  Synthetic Polynucleotide
atggccttaccagtgaccgccttgctcctgccgctggccttgctgctccacgccgccaggccgcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggcggaggcggaagtggaggcggaggatctggcggcggaggctctcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1930 - DNA, 1056 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggcggaggcggaagtggaggcggaggatctggcggcggaggctctcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1931 - DNA, 1056 bp, Artificial Sequence
  Synthetic Polynucleotide
atggccttaccagtgaccgccttgctcctgccgctggccttgctgctccacgccgccaggccgcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggcggaggcggaagtggaggcggaggatctggcggcggaggctctgacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1932 - DNA, 1080 bp, Artificial Sequence
  Synthetic Polynucleotide
atggccttaccagtgaccgccttgctcctgccgctggccttgctgctccacgccgccaggccggacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggcggaggcggaagtggaggcggaggatctggcggcggaggctctcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1933 - DNA, 1080 bp, Artificial Sequence
  Synthetic Polynucleotide
atggccttaccagtgaccgccttgctcctgccgctggccttgctgctccacgccgccaggccgcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggcggaggcggaagtggaggcggaggatctggcggcggaggctctgacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1934 - DNA, 1065 bp, Artificial Sequence
  Synthetic Polynucleotide
atggccttaccagtgaccgccttgctcctgccgctggccttgctgctccacgccgccaggccggacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggcggaggcggaagtggaggcggaggatctggcggcggaggctctgaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1935 - DNA, 1065 bp, Artificial Sequence
  Synthetic Polynucleotide
atggccttaccagtgaccgccttgctcctgccgctggccttgctgctccacgccgccaggccggaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggcggaggcggaagtggaggcggaggatctggcggcggaggctctgacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1936 - DNA, 1056 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1937 - DNA, 1056 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggcggaggcggaagtggaggcggaggatctggcggcggaggctctgacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1938 - DNA, 1056 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggcggaggcggaagtggaggcggaggatctggcggcggaggctctgaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1939 - DNA, 1056 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggcggaggcggaagtggaggcggaggatctggcggcggaggctctgacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1940 - DNA, 1080 bp, Artificial Sequence
  Synthetic Polynucleotide
atggccttaccagtgaccgccttgctcctgccgctggccttgctgctccacgccgccaggccgcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggcggaggcggaagtggaggcggaggatctggcggcggaggctctcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1941 - DNA, 1080 bp, Artificial Sequence
  Synthetic Polynucleotide
atggccttaccagtgaccgccttgctcctgccgctggccttgctgctccacgccgccaggccgcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggcggaggcggaagtggaggcggaggatctggcggcggaggctctcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1942 - DNA, 1101 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggcggaggcggaagtggaggcggaggatctggcggcggaggctctgaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1943 - DNA, 1101 bp, Artificial Sequence
  Synthetic Polynucleotide
atggccttaccagtgaccgccttgctcctgccgctggccttgctgctccacgccgccaggccggaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggcggaggcggaagtggaggcggaggatctggcggcggaggctctgacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaatga

SEQ ID NO: 1944 - DNA, 1017 bp, Artificial Sequence
  Synthetic Polynucleotide
atggccttaccagtgaccgccttgctcctgccgctggccttgctgctccacgccgccaggccggtcgtgatgacccagacccctctgagcctgagcgtgacactgggacagcctgccagcatcagctgcaagagcagccagagcctgctgcacagcgacggcaagacctacctgaactggctgcagcagaggccaggccagagccctcggagactgatctacctggtgtccaagctggacagcggcgtgcccgatagattttccggctctggcagcggcaccgacttcaccctgaagatcagccgggtggaagccgaggacgtgggcatctactactgttggcagggcacccacctgtggacctttggcggcggaacaaaggtggaaatcaagggcggaggcggaagtggaggcggaggatctggcggcggaggctctgaagtgcacctggtggaaagcggcggaggactggtgcagccagggggatctctgagactgtcttgtgccgccagcggcttcaccttcagcagatacggcatgagctgggtgcgccaggcccctggaaaaggactggaactggtggctatgatgaagaccaagggcggcagaacctactaccccgacagcgtgaagggccggttcaccatctcccgggacaacgccaagaacagcctgtacctgcagatgaactccctgcgggccgaggacaccgccatctactattgtgcctccgacggctactactggggccagggaacaaccgtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1945 - DNA, 1026 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagcgccaccagcagcgtgtcctacatgcactggtatcagcagaagcccggcaaggcccctaagcggtggatctacgataccagcaaactggcctctggcgtgcccagcagattttctggctctggcagcggcaccgagttcaccctgacaatatctagcctccagcctgaggacttcgccacctactactgccagcagtggtccagcaatcccctgacctttggacagggcaccaagctggaaatcaaaggcggaggcggaagtggaggcggaggatctggcggcggaggctctcaagttcagctggttcagtctggggccgaagtgaagaaacctggggcctctgtgaaggtgtcctgcaaggccagcggctacaagttcaccagctacgtgatgcactgggtccgacaggctccaggacaaggactggaatggatcggctacatcaacccctacaacgacgtgaccaagtacaacgagaagttcaagggcagagtgaccatcaccgccgacaagagcacaagcaccgcctacatggaactgagcagcctgagaagcgaggacaccgccgtgcactattgtgccagaggcagctactacgactacgacggctttgtgtattggggccagggcaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1946 - DNA, 1041 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagagcctgctgaacagccggaccagaaagaactacctggcctggtatcagcagaagcccggacagtctcccaagctgctgatctactggaccagcaccagaaagtccggcgtgcccgatagattttctggctctggcagcggcaccgacttcaccctgacaatttctagcctgcaagccgaggacgtggccgtgtactactgcaagcagagcttcatcctgcggacctttggccagggcaccaaggtggaaatcaaaggcggaggcggaagtggaggcggaggatctggcggcggaggctctgaagttcagctggttcagagcggagccgaagtgaagaaacctggggcctctgtgaaggtgtcctgcaaggcttccggcttcaccttcaccagctactacatccactgggtccgacaggcccctggacaaggactggaatggatcggctggatctaccccgagaacgacaacaccaagtacaacgagaagttcaaggaccgcgtgaccatcaccgccgataccagcacaagcaccgcctacctggaactgagcagcctgagaagcgaggacaccgccgtgtattattgcgccagagatgcctacagccggtactacttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1947 - DNA, 1050 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagactgctgagcagctacggccacacatacctgcactggtatctccagaagcctggacagagcccacagctgctgatctacgaggtgtccaacagattcagcggcgtgcccgatagattttccggctctggcagcggcaccgacttcaccctgaagattagcagagtggaagccgaggacgtgggcgtgtactactgtagccagagcacacacgtgcccctgacctttggacagggcaccaaggtggaaatcaaaggcggaggcggaagtggaggcggaggatctggcggcggaggctctgaagtgcagctggttgaatctggcggcggactggttaagcctggcggatctctgagactgagctgtgccgccagcggctacaccttcagcaattactggatcggctgggtccgacaggcccctggaaaaggactggaatggatcggcgacatctaccctggcggcaactacatcagaaacaacgagaagttcaaggacaagaccacactgagcgccgacaccagcaagaacacagcctacctccagatgaacagcctgaaaaccgaggacaccgccgtgtactattgcggcagcagcttcggcagcaactacgtgttcgcctggttcacctattggggccagggcacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1948 - DNA, 1044 bp, Artificial Sequence
  Synthetic Polynucleotide
atggccttaccagtgaccgccttgctcctgccgctggccttgctgctccacgccgccaggccggacatcgtgatgtctcagagccctagcagcctggctgtgtccgctggcgagaaagtgaccatgagctgcaagagcagccagagcctgttcaacagccggaccagaaagaactacctggcctggtatcagcagaagcccggacagtctcccaagctgctgatctactgggccagcgccagagatagcggagtgcctgctagattcacaggcagcggcagcgagacatacttcaccctgaccatcagcagagtgcaggccgaggatctggccgtgtactactgtatgcagagcttcaacctgcggaccttcggcggaggcaccaagctggaaatcaaaggcggaggcggaagtggaggcggaggatctggcggcggaggctctgaagtgaacctggttgaatccggcggaggactggttcagcctggcggatctctgagactgagctgtgccaccagcggcttcaccttcaccgacaactacatgagctgggtccgacagcctcctggcaaagctctggaatggctgggcttcatcagaaacaaggccaacggctacaccaccgactacagcgcctctgtgcggggcagattcaccatctccagagacaacagccagtccatcctgtacctccagatgaacgccctgagagccgaggatagcgccacctactactgtgccagagatgtgggcagcaactacttcgactattggggccagggcaccacactgaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1949 - DNA, 1047 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctcggcgagcgcgtgacaatgaattgcaagagcagccagagcctgctgtactccaccaaccagaagaactacctggcctggtatcagcagaagcccggacagtctcccaagctgctgatctactgggccagcaccagagaaagcggcgtgcccgatagattttctggctctggcagcggcaccgacttcaccctgacaatcagttctgtgcaggccgaggacgtggccgtgtactactgccagcagtattacagctaccggaccttcggcggaggcaccaagctggaaatcaaaggcggaggcggaagtggaggcggaggatctggcggcggaggctctcaagttcagctccagcagtctggccccgagtggaaacctggcgcttctgtgaagatgagctgcaaggccagcggctacaccttcaccagctacgtgatccactgggtccgacagaagcctggccaaggactggattggatcggctacatcaacccctacaacgacggcaccgattacgacgagaagttcaagggcaaagccacactgaccagcgacaccagcacaagcaccgcctacatggaactgagcagcctgagaagcgaggacaccgccgtgtattattgcgccagagagaaggacaactacgccaccggcgcttggtttgcctattggggccagggaacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1950 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatcagaaactacctgaactggtatcagcagaagcccggcaaggcccctaagctgctgatctactacaccagcagactggaaagcggcgtgcccagcagattttctggcagcggctctggcaccgactacaccctgacaatatccagcctccagcctgaggacttcgccacctactattgccagcagggcaacaccctgccttggacatttggccagggcaccaaggtggaaatcaaaggcggaggcggaagtggaggcggaggatctggcggcggaggctctgaagtgcagctggttgaatcaggtggcggcctggttcaacctggcggatctctgagactgagctgtgccgccagcggctacagctttaccggctacaccatgaactgggtccgacaggcccctggcaaaggactggaatgggtcgccctgattaacccctacaagggcgtgtccacctacaaccagaagttcaaggacaggttcaccatcagcgtggacaagagcaagaacaccgcctacctccagatgaactccctgagagccgaggacaccgccgtgtactattgtgccagaagcggctactacggcgacagcgactggtactttgatgtgtggggccagggaaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1951 - DNA, 1041 bp, Artificial Sequence
  Synthetic Polynucleotide
atggccttaccagtgaccgccttgctcctgccgctggccttgctgctccacgccgccaggccgagcacaggatctcaggtgcagctccagcagtctggccctgagcttgtgaaacctggcgcttccgtgaagatgagctgcaaggccagcggctacaccttcaccgactatgtgattaactggggcaagcagcggagcggccaaggactggaatggatcggcgaaatctaccctggcagcggcaccaactactacaacgagaagttcaaggccaaggccacactgaccgccgacaagagcagcaatatcgcctacatgcagctgagcagcctgaccagcgaagatagcgccgtgtacttctgcgccagaagaggcagatacggcctgtacgctatggactattggggccagggcaccagcgtgacagtgtcatctggcggaggcggaagtggaggcggaggatctggcggcggaggctctgacatccagatgacccagacaaccagcagcctgtctgccagcctgggcgatagagtgaccatcagctgtagagccagccaggacatcagcaactacctgaactggtatcagcagaaacccgacggcaccgtgaagctgctgatctactacaccagcagactgcacagcggcgtgcccagcagattttctggctctggaagcggcacagattactccctgaccatcaacaacctggaacaagaggacattgccacctacttttgccagcaaggcaacacccggccttggacatttggcggaggcaccaagctggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1952 - DNA, 1026 bp, Artificial Sequence
  Synthetic Polynucleotide
atggccttaccagtgaccgccttgctcctgccgctggccttgctgctccacgccgccaggccgcagatcgtgctgacacagagccctgccatcatgagcgcttccccaggcgagaaagtgaccatgacctgtagcgccacaagcagcgtgtcctacatgcactggtatcagcagaagtccggcacaagccccaagcggtggatctacgataccagcaaactggcctctggcgtgcccgctagattttctggctctggcagcggcaccagctacagcctgacaatcagcagcatggaagccgaggatgccgccacctactactgccagcagtggtccagcaatcccctgacatttggagccggcaccaagctggaactgaaaggcggaggcggaagtggaggcggaggatctggcggcggaggctctgaagttcagctccagcagtctggccccgagcttgtgaaacctggcgcttccgtgaagatgagctgcaaggccagcggctacaagttcacctcctacgtgatgcactgggtcaagcagaaacccggccagggccttgagtggatcggctacatcaacccctacaacgacgtgaccaagtacaacgagaagttcaagggcaaagccacactgaccagcgacaagagcagcagcaccgcctacatggaactgagcagcctgacctctgaggacagcgccgtgcactattgtgccagaggcagctactacgactacgacggctttgtgtattggggccagggcaccctggttaccgtttctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1953 - DNA, 1029 bp, Artificial Sequence
  Synthetic Polynucleotide
atggccttaccagtgaccgccttgctcctgccgctggccttgctgctccacgccgccaggccggacatccagatgacacagagccctgccagccagtctgcctctctgggagagtctgtgaccatcacctgtctggcctctcagaccatcggaacatggctggcctggtatcagcagaagcctggcaagtctccccagctgctgatctacgccgctacatctctggctgatggcgtgcccagcagattttctggcagcggctccggcaccaagttcagcctgaagatcagaaccctccaggccgaggacttcgtgtcctactattgccagcagctgtactccaagccttacacctttggcggaggcaccaagctggaaatcaagagaggcggaggcggaagtggaggcggaggatctggcggcggaggctctgaagttcagctgcaacagagcggagccgagctggttaagcctggcgcttctgtgaagctgagctgtacccctagcggcttcaacgtgaaggacacctacatccactgggtcaagcagcggcctaagcagggcctcgaatggatcggaagaatcgaccctagcgacggcgacattaagtacgaccccaagttccagggcaaagccaccatcaccgccgacaccagcagcaacacagtgtctctccagctgagcagcctgaccagcgaagataccgccgtgtactattgcgcccgttggttcggcgattacggggccatgaattattggggccagggcaccagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1954 - DNA, 1398 bp, Artificial Sequence
  Synthetic Polynucleotide
atggccttaccagtgaccgccttgctcctgccgctggccttgctgctccacgccgccaggccgaaagaggaaacccccgagacacccgaaaccgacagcgaggaagaagtgaccatcaaggccaacctgatcttcgccaacggcagcacccagaccgccgagttcaagggcaccttcgagaaggccaccagcgaagcctacgcctacgccgacaccctgaagaaggacaacggcgagtacaccgtggacgtggccgacaagggctacacactgaacatcaagttcgccggcaaagaaaagacccccgaggaacccaaagaagaagtgactattaaggctaatctgatctacgctgacggcaagacacagacagctgagtttaaggggacattcgaagaagccaccgccgaggcttacagatacgccgatgccctgaaaaaagataatggggagtatacagtggatgtggctgataagggatataccctgaatattaagtttgctgggaaagagaaaacacctgaagaacctaaagaagaagtgacaatcaaagcaaacctgatctatgccgatggaaagacccagactgctgagttcaaaggcacttttgaagaggccactgccgaagcctatcgctatgctgacctgctggctaaagagaacggaaagtacactgtggatgtggcagacaaagggtatactctgaatatcaaattcgccggaaaagagaaaactccagaggaacccaaagaagaagtgaccatcaaagccaatctgatctacgcagatgggaaaactcagaccgcagagtttaaagggactttcgccgaggccacagctgaggcatatagatatgccgatctgctggcaaaagaaaatggcaagtataccgccgacctggaagatggcggctacaccatcaacatccgcttcgccgggaagaaggtggacgagaagcccgaagagaaagaacaagtgactatcaaagagaacatctacttcgaggacggcaccgtgcagaccgccacctttaagggaacctttgccgaggctaccgcagaagcctatagatacgcagacctgctgtccaaagagcatgggaagtatactgctgatctggaagatggggggtatacaatcaatatcagatttgccggcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaa

SEQ ID NO: 1955 - DNA, 1029 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1956 - DNA, 1029 bp, Artificial Sequence
  Synthetic Polynucleotide
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1957 - DNA, 1029 bp, Artificial Sequence
  Synthetic Polynucleotide
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1958 - DNA, 1032 bp, Artificial Sequence
  Synthetic Polynucleotide
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1959 - DNA, 1053 bp, Artificial Sequence
  Synthetic Polynucleotide
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1960 - DNA, 1104 bp, Artificial Sequence
  Synthetic Polynucleotide
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1961 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1962 - DNA, 1032 bp, Artificial Sequence
  Synthetic Polynucleotide
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1963 - DNA, 1050 bp, Artificial Sequence
  Synthetic Polynucleotide
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1964 - DNA, 1065 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1965 - DNA, 1026 bp, Artificial Sequence
  Synthetic Polynucleotide
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1966 - DNA, 1056 bp, Artificial Sequence
  Synthetic Polynucleotide
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1967 - DNA, 1029 bp, Artificial Sequence
  Synthetic Polynucleotide
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1968 - DNA, 1041 bp, Artificial Sequence
  Synthetic Polynucleotide
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1969 - DNA, 1035 bp, Artificial Sequence
  Synthetic Polynucleotide
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1970 - DNA, 1035 bp, Artificial Sequence
  Synthetic Polynucleotide
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1971 - DNA, 1038 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1972 - DNA, 1032 bp, Artificial Sequence
  Synthetic Polynucleotide
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1973 - DNA, 1065 bp, Artificial Sequence
  Synthetic Polynucleotide
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1974 - DNA, 1032 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1975 - DNA, 1035 bp, Artificial Sequence
  Synthetic Polynucleotide
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1976 - DNA, 1038 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1977 - DNA, 1038 bp, Artificial Sequence
  Synthetic Polynucleotide
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1978 - DNA, 1038 bp, Artificial Sequence; identical to SEQ ID NO: 1977
  Synthetic Polynucleotide

SEQ ID NO: 1979 - DNA, 1038 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1980 - DNA, 1044 bp, Artificial Sequence
  Synthetic Polynucleotide
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1981 - DNA, 1035 bp, Artificial Sequence
  Synthetic Polynucleotide
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1982 - DNA, 1044 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1983 - DNA, 1038 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1984 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1985 - DNA, 1065 bp, Artificial Sequence
  Synthetic Polynucleotide
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1986 - DNA, 1041 bp, Artificial Sequence
  Synthetic Polynucleotide
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1987 - DNA, 1035 bp, Artificial Sequence; identical to SEQ ID NO: 1984
  Synthetic Polynucleotide

SEQ ID NO: 1988 - DNA, 1032 bp, Artificial Sequence
  Synthetic Polynucleotide
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1989 - DNA, 1038 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1990 - DNA, 1032 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1991 - DNA, 1047 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1992 - DNA, 1023 bp, Artificial Sequence
  Synthetic Polynucleotide
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1993 - DNA, 1041 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1994 - DNA, 1041 bp, Artificial Sequence
  Synthetic Polynucleotide
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1995 - DNA, 1020 bp, Artificial Sequence
  Synthetic Polynucleotide
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1996 - DNA, 1035 bp, Artificial Sequence
  Synthetic Polynucleotide
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1997 - DNA, 1026 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1998 - DNA, 1056 bp, Artificial Sequence
  Synthetic Polynucleotide
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 1999 - DNA, 1044 bp, Artificial Sequence
  Synthetic Polynucleotide
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2000 - DNA, 1122 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2001 - DNA, 1119 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2002 - DNA, 1167 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2003 - DNA, 1035 bp, Artificial Sequence
  Synthetic Polynucleotide
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2004 - DNA, 1032 bp, Artificial Sequence
  Synthetic Polynucleotide
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2005 - DNA, 1023 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2006 - DNA, 1053 bp, Artificial Sequence
  Synthetic Polynucleotide
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2007 - DNA, 1014 bp, Artificial Sequence
  Synthetic Polynucleotide
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2008 - DNA, 1038 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2009 - DNA, 1026 bp, Artificial Sequence
  Synthetic Polynucleotide
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2010 - DNA, 1038 bp, Artificial Sequence
  Synthetic Polynucleotide
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2011 - DNA, 1026 bp, Artificial Sequence
  Synthetic Polynucleotide
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2012 - DNA, 1050 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2013 - DNA, 1035 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2014 - DNA, 1047 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2015 - DNA, 1047 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2016 - DNA, 1029 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2017 - DNA, 1035 bp, Artificial Sequence
  Synthetic Polynucleotide
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2018 - DNA, 1026 bp, Artificial Sequence
  Synthetic Polynucleotide
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2019 - DNA, 1029 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2020 - DNA, 1017 bp, Artificial Sequence
  Synthetic Polynucleotide
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2021 - DNA, 1110 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2022 - DNA, 1023 bp, Artificial Sequence
  Synthetic Polynucleotide
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2023 - DNA, 1050 bp, Artificial Sequence
  Synthetic Polynucleotide
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2024 - DNA, 1062 bp, Artificial Sequence
  Synthetic Polynucleotide
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2025 - DNA, 1035 bp, Artificial Sequence
  Synthetic Polynucleotide
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2026 - DNA, 1020 bp, Artificial Sequence
  Synthetic Polynucleotide
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2027 - DNA, 1029 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2028 - DNA, 1014 bp, Artificial Sequence
  Synthetic Polynucleotide
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2029 - DNA, 1044 bp, Artificial Sequence
  Synthetic Polynucleotide
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2030 - DNA, 1020 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2031 - DNA, 1029 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2032 - DNA, 1059 bp, Artificial Sequence
  Synthetic Polynucleotide
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2033 - DNA, 1050 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2034 - DNA, 1026 bp, Artificial Sequence
  Synthetic Polynucleotide
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2035 - DNA, 1005 bp, Artificial Sequence
  Synthetic Polynucleotide
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2036 - DNA, 1020 bp, Artificial Sequence
  Synthetic Polynucleotide
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2037 - DNA, 1029 bp, Artificial Sequence
  Synthetic Polynucleotide
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2038 - DNA, 1044 bp, Artificial Sequence
  Synthetic Polynucleotide
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2039 - DNA, 1029 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2040 - DNA, 1047 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2041 - DNA, 1041 bp, Artificial Sequence
  Synthetic Polynucleotide
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2042 - DNA, 1041 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2043 - DNA, 1035 bp, Artificial Sequence
  Synthetic Polynucleotide
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2044 - DNA, 1026 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2045 - DNA, 1029 bp, Artificial Sequence
  Synthetic Polynucleotide
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2046 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2047 - DNA, 1038 bp, Artificial Sequence
  Synthetic Polynucleotide
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2048 - DNA, 1038 bp, Artificial Sequence
  Synthetic Polynucleotide
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2049 - DNA, 1038 bp, Artificial Sequence
  Synthetic Polynucleotide
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2050 - DNA, 1032 bp, Artificial Sequence
  Synthetic Polynucleotide
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2051 - DNA, 1032 bp, Artificial Sequence
  Synthetic Polynucleotide
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2052 - DNA, 1047 bp, Artificial Sequence
  Synthetic Polynucleotide
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2053 - DNA, 1047 bp, Artificial Sequence
  Synthetic Polynucleotide
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2054 - DNA, 1041 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2055 - DNA, 1026 bp, Artificial Sequence
  Synthetic Polynucleotide
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2056 - DNA, 1011 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2057 - DNA, 1029 bp, Artificial Sequence
  Synthetic Polynucleotide
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2058 - DNA, 1050 bp, Artificial Sequence
  Synthetic Polynucleotide
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2059 - DNA, 1053 bp, Artificial Sequence
  Synthetic Polynucleotide
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2060 - DNA, 1044 bp, Artificial Sequence
  Synthetic Polynucleotide
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2061 - DNA, 1035 bp, Artificial Sequence
  Synthetic Polynucleotide
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2062 - DNA, 1068 bp, Artificial Sequence
  Synthetic Polynucleotide
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2063 - DNA, 1056 bp, Artificial Sequence
  Synthetic Polynucleotide
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2064 - DNA, 1038 bp, Artificial Sequence
  Synthetic Polynucleotide
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2065 - DNA, 1029 bp, Artificial Sequence
  Synthetic Polynucleotide
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2066 - DNA, 1023 bp, Artificial Sequence
  Synthetic Polynucleotide
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2067 - DNA, 1029 bp, Artificial Sequence
  Synthetic Polynucleotide
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2068 - DNA, 1035 bp, Artificial Sequence
  Synthetic Polynucleotide
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2069 - DNA, 1050 bp, Artificial Sequence
  Synthetic Polynucleotide
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2070 - DNA, 1032 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2071 - DNA, 1035 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2072 - DNA, 1032 bp, Artificial Sequence
  Synthetic Polynucleotide
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2073 - DNA, 1029 bp, Artificial Sequence
  Synthetic Polynucleotide
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2074 - DNA, 1029 bp, Artificial Sequence
  Synthetic Polynucleotide
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2075 - DNA, 1035 bp, Artificial Sequence
  Synthetic Polynucleotide
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2076 - DNA, 1029 bp, Artificial Sequence
  Synthetic Polynucleotide
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2077 - DNA, 1026 bp, Artificial Sequence
  Synthetic Polynucleotide
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2078 - DNA, 1026 bp, Artificial Sequence
  Synthetic Polynucleotide
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2079 - DNA, 1050 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2080 - DNA, 1068 bp, Artificial Sequence
  Synthetic Polynucleotide
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2081 - DNA, 1023 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2082 - DNA, 1053 bp, Artificial Sequence
  Synthetic Polynucleotide
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2083 - DNA, 1041 bp, Artificial Sequence
  Synthetic Polynucleotide
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2084 - DNA, 993 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2085 - DNA, 1023 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2086 - DNA, 1035 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2087 - DNA, 1023 bp, Artificial Sequence
  Synthetic Polynucleotide
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2088 - DNA, 1026 bp, Artificial Sequence
  Synthetic Polynucleotide
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2089 - DNA, 1041 bp, Artificial Sequence
  Synthetic Polynucleotide
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2090 - DNA, 1023 bp, Artificial Sequence
  Synthetic Polynucleotide
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2091 - DNA, 1026 bp, Artificial Sequence
  Synthetic Polynucleotide
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2092 - DNA, 1050 bp, Artificial Sequence
  Synthetic Polynucleotide
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2093 - DNA, 1038 bp, Artificial Sequence; identical to SEQ ID NO: 2010
  Synthetic Polynucleotide

SEQ ID NO: 2094 - DNA, 1029 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2095 - DNA, 1029 bp, Artificial Sequence
  Synthetic Polynucleotide
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2096 - DNA, 1026 bp, Artificial Sequence
  Synthetic Polynucleotide
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2097 - DNA, 1023 bp, Artificial Sequence
  Synthetic Polynucleotide
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2098 - DNA, 1026 bp, Artificial Sequence
  Synthetic Polynucleotide
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2099 - DNA, 1038 bp, Artificial Sequence
  Synthetic Polynucleotide
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2100 - DNA, 1047 bp, Artificial Sequence
  Synthetic Polynucleotide
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2101 - DNA, 1053 bp, Artificial Sequence
  Synthetic Polynucleotide
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2102 - DNA, 1050 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2103 - DNA, 1020 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2104 - DNA, 1026 bp, Artificial Sequence
  Synthetic Polynucleotide
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2105 - DNA, 1026 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2106 - DNA, 1029 bp, Artificial Sequence
  Synthetic Polynucleotide
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2107 - DNA, 1023 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2108 - DNA, 1080 bp, Artificial Sequence
  Synthetic Polynucleotide
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2109 - DNA, 1071 bp, Artificial Sequence
  Synthetic Polynucleotide
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2110 - DNA, 993 bp, Artificial Sequence
  Synthetic Polynucleotide
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2111 - DNA, 1041 bp, Artificial Sequence
  Synthetic Polynucleotide
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2112 - DNA, 1014 bp, Artificial Sequence
  Synthetic Polynucleotide
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2113 - DNA, 1017 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2114 - DNA, 1017 bp, Artificial Sequence
  Synthetic Polynucleotide
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2115 - DNA, 1050 bp, Artificial Sequence
  Synthetic Polynucleotide
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2116 - DNA, 1038 bp, Artificial Sequence
  Synthetic Polynucleotide
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2117 - DNA, 1023 bp, Artificial Sequence
  Synthetic Polynucleotide
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2118 - DNA, 1035 bp, Artificial Sequence
  Synthetic Polynucleotide
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2119 - DNA, 1062 bp, Artificial Sequence
  Synthetic Polynucleotide
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2120 - DNA, 1035 bp, Artificial Sequence
  Synthetic Polynucleotide
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2121 - DNA, 1044 bp, Artificial Sequence
  Synthetic Polynucleotide
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2122 - DNA, 1029 bp, Artificial Sequence
  Synthetic Polynucleotide
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2123 - DNA, 1032 bp, Artificial Sequence
  Synthetic Polynucleotide
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2124 - DNA, 1023 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2125 - DNA, 1059 bp, Artificial Sequence
  Synthetic Polynucleotide
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2126 - DNA, 1029 bp, Artificial Sequence
  Synthetic Polynucleotide
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2127 - DNA, 1020 bp, Artificial Sequence
  Synthetic Polynucleotide
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2128 - DNA, 1035 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2129 - DNA, 1032 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2130 - DNA, 1038 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2131 - DNA, 1026 bp, Artificial Sequence
  Synthetic Polynucleotide
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2132 - DNA, 1020 bp, Artificial Sequence
  Synthetic Polynucleotide
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2133 - DNA, 1053 bp, Artificial Sequence
  Synthetic Polynucleotide
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2134 - DNA, 1038 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2135 - DNA, 1041 bp, Artificial Sequence
  Synthetic Polynucleotide
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2136 - DNA, 1041 bp, Artificial Sequence
  Synthetic Polynucleotide
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2137 - DNA, 1077 bp, Artificial Sequence
  Synthetic Polynucleotide
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2138 - DNA, 1059 bp, Artificial Sequence
  Synthetic Polynucleotide
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2139 - DNA, 1029 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2140 - DNA, 1026 bp, Artificial Sequence
  Synthetic Polynucleotide
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2141 - DNA, 1032 bp, Artificial Sequence
  Synthetic Polynucleotide
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2142 - DNA, 1005 bp, Artificial Sequence
  Synthetic Polynucleotide
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2143 - DNA, 1014 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2144 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2145 - DNA, 1023 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2146 - DNA, 1026 bp, Artificial Sequence
  Synthetic Polynucleotide
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2147 - DNA, 1029 bp, Artificial Sequence
  Synthetic Polynucleotide
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2148 - DNA, 1044 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagaggcggaggcggaagtggaggcggaggatctggcggcggaggctctcaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2149 - DNA, 1068 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2150 - DNA, 1050 bp, Artificial Sequence
  Synthetic Polynucleotide
atggccttaccagtgaccgccttgctcctgccgctggccttgctgctccacgccgccaggccggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacgccgcctaccctacttttggcggagggaccaaggttgagatcaaacggggcggaggcggaagtggaggcggaggatctggcggcggaggctctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggcggtgtactactgcgccagagagagttggccaatggacgtatggggccagggaacaactgtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2151 - DNA, 1065 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaaaggcggaggcggaagtggaggcggaggatctggcggcggaggctctcaaatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2152 - DNA, 1056 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagaatctcctggcctttcacttttggcggagggaccaaggttgagatcaaaggcggaggcggaagtggaggcggaggatctggcggcggaggctctgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggcggtgtactactgcgcaagagccgagatgggagccgtattcgacatatggggtcagggtacaatggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2153 - DNA, 1071 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagacacgtctggcctcctacttttggcggagggaccaaggttgagatcaaacggggcggaggcggaagtggaggcggaggatctggcggcggaggctctcagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagaggcaggggatatgcaaccagcttagccttcgatatctggggtcagggtacaatggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2154 - DNA, 1086 bp, Artificial Sequence
  Synthetic Polynucleotide
atggccttaccagtgaccgccttgctcctgccgctggccttgctgctccacgccgccaggccggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagggactcggcctccctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgccagagacggtacttatctaggtggtctctggtacttcgacttatgggggagaggtaccttggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2155 - DNA, 1101 bp, Artificial Sequence
  Synthetic Polynucleotide
atggccttaccagtgaccgccttgctcctgccgctggccttgctgctccacgccgccaggccggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgcccacactcctttcacttttggcggagggaccaaggttgagatcaaacggggcggaggcggaagtggaggcggaggatctggcggcggaggctctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagaactcctgaatactcctccagcatatggcactattactacggcatggacgtatggggccagggaacaactgtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2156 - DNA, 1074 bp, Artificial Sequence
  Synthetic Polynucleotide
atggccttaccagtgaccgccttgctcctgccgctggccttgctgctccacgccgccaggccggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatagcgcatccaccagggccactggtatcccagccaggttcagtggcagtgggtctgggacagagttcactctcaccatcagcagcctgcagtctgaagattttgcagtttattactgtcagcagcaccacgtctggcctctcacttttggcggagggaccaaggttgagatcaaacggggcggaggcggaagtggaggcggaggatctggcggcggaggctctcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgtcaaggggccgttgcaggagccgccatacgattatggaatggacgtatggggccagggaacaactgtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2157 - DNA, 1062 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattctactacccttggacttttggcggagggaccaaggttgagatcaaacggggcggaggcggaagtggaggcggaggatctggcggcggaggctctgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcaaccattagtagtagtagtagtaccatatactacgcagactctgtgaagggccgattcaccatctccagagacaatgccaagaactcactgtatctgcaaatgaacagcctgagagctgaggacacggcggtgtactactgcgccagaggttctcaggagcacctgattttcgattattggggacagggtacattggtcaccgtctcctcaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2158 - DNA, 1077 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtaccgccagcagcagagtgtccagcagctacctgcactggttccagcagaagcctggcaaggcccctaagctgctgatctacagcaccagcaatctggcctctggcgtgcccagcagattttctggctctggcagcggcaccgacttcaccctgacaatatctagcctccagcctgaggacttcgccacctactactgccaccagtaccacagaagcccctacacattcggccagggcaccaaggtggaaatcaagagaggcggaggcggaagtggaggcggaggatctggcggcggaggctctgaagttcagctggttgaatctggcggcggactggttcaacctggcggatctctgagactgagctgtgccgcctctggctacgccttcagcaacagctggatcaactgggtccgacaggcccctggcaaaggactggaatgggtcggacaaatctaccccggcgactacgacaccaactacaacggcaagttcaagggcagattcaccatcagccgggacaagagcaagaacaccgcctacctccagatgaactccctgagagccgaggacaccgccgtgtactattgtgctagaggcggctccatctactacggcaacctgggcttcttcgacgtgtggggacagggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2159 - DNA, 1047 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgtagcgccagcagcagcgtgacctacatgtactggtatcagcagaagcccggcaaggcccctaagctgctgatctacgacaccagcaatctggcctctggcgtgcccagcagattttctggctctggcagcggcaccgactacaccctgacaatatctagcctccagcctgaggacttcgccacctactactgccagcagtggtccaactatcccctgacattcggccagggcaccaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacagcttcatcgagtacaccatcaactgggtccgacaggcccctggacaaggcctggaatggatcggcaacatcgacccctactacggcacaacctactacaaccagatgttcaccggcagagccacactgaccgtggacacctctatcagcaccgcctacatggaactgagccggctgagatccgatgacaccgccgtgtactattgtgccagaggcagcgcctggtttccctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2160 - DNA, 1047 bp, Artificial Sequence
  Synthetic Polynucleotide
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcgagaacatctacagctacctggcctggtatcagcagaagcctggcaaggcccctaagctgctgatctacaacaccaagacactcggcgagggcgtgcccagcagattttctggttctggcagcggcaccgacttcaccctgaccatatctagcctgcagcctgaggacttcgccacctactactgccagcaccactacggcacccctttcacatttggccctggcaccaaggtggacatcaaaggcggaggcggaagtggaggcggaggatctggcggcggaggctctcaagttcagctggttcagagcggagccgaagtgaagaaacctggggcctctgtgaaggtgtcctgcaaggccagcggctacaccttcagcgactattgggtgcactgggtccgacaggctccaggacaaggactggaatggatgggagccatcgacggcagcgataccttcaacgattacagccagaaattcaaaggccgcgtgaccatgaccagagacaccagcatcagcaccgcctacatggaactgagccggctgagatccgatgacaccgccgtgtactattgtgccagaggcggcctgctgcagtattggggacagggaacactggtcaccgtgtcctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2161 - DNA, 1059 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgcactggtatcagcagaagcccggacaggcccctagactgctgatctacgataccagcaagctggcctctgacatccccgccagattttctggcagcggctctggcaccgatttcaccctgaccataagcagcctggaacctgaggacttcgccgtgtactactgtcagcagggcagcgtgtaccccttcacatttggcggcggaacaaaggtggaaatcaaaggcggaggcggaagtggaggcggaggatctggcggcggaggctctcaagttcagctgcaagagtctggccctggcctggttaagcctagcggaacactgagcctgacctgtgctgtgtctggcggcagcatcagcacatctggcatgggcgttggctgggtccgacagcctcctggaaaaggcctggaatggatcggccacatttggtgggacgacgacaagcggtacaaccccgctctgaagtccagagtgaccatcagcgtggacaagagcaagaaccagttcagcctgcggctgagcagcgtgacagctgcagataccgccgtgtattattgcgcccggatggaactgtggtcctactacttcgactactggggcaagggcaccaccgtgactgtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2162 - DNA, 1071 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgacagagtgaccatctcttgtagagccagccaggacatcagcaactacctgaactggtatcagcagaaacccgacggcaccgtgaagctgctgatctactacaccagcatcctgcacagcggcgtgcccagcagattttctggctctggcagcggcaccgactacagcctgaccatcagcaatctggaacaagaggacttcgctacctacttctgccagcaaggcaacaccctgccttggacatttggcggaggcaccaagctggaaatcaaagctggcggaggcggaagtggaggcggaggatctggcggcggaggctctgaagtgcaactggttgaatctggcggcggactggttaagcctggcggatctctgaagctgagctgtgccgcctctggcttcgccttcagcatctacgatatgagctgggtccgacagacccctgagaagagactggaatgggtcgcctacatctctagcggcggagggacctactatcccgacacagtgaagggcagattcaccatctccagagacaacgccaagaacaccctgtacctccagatgagcagcctgaagtccgaggacaccgccatgtactactgcgccagacacagcggctatggcacacattggggagtgctgtttgcctactggggccagggaacactggtcacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2163 - DNA, 1071 bp, Artificial Sequence
  Synthetic Polynucleotide
atggccttaccagtgaccgccttgctcctgccgctggccttgctgctccacgccgccaggccggatattcaactgacacaatcccccagctcactcagcgccagcgtgggggacagggttagctttacctgtcaagcctctcaggatataaataactttctgaactggtatcaacagaagcctgggaaggcgcccaaactcctgatctatgatgcgtccaacctggaaactggcgtgccttcacgctttagcggctctggcagtggtacagacttcacttttaccatctcttcacttcagccggaggacatcgccacatattactgtcaacagtacggaaacttgccctttacttttggaggcggcaccaaagttgaaatcaaaagaggcggaggcggaagtggaggcggaggatctggcggcggaggctctcaggtccaactgcaagaaagcggacccggactggtgaagccttctgagacacttagtctgacgtgcacggtcagtggcggctccatctcctcctattattggtcatggatacgacaacccccaggtaagggcctggaatggattggctatatctactattcaggaagcacgaactacaatcccagcctgaagtcccgagtgacaatttcagtagataccagtaaaaaccagttcagtcttaaactgtcaagcgtgacagctgccgacaccgctgtgtattactgcgtctcactggtgtattgtggaggggattgttatagcgggttcgattattggggacagggaaccctggtgactgtatcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2164 - DNA, 1077 bp, Artificial Sequence
  Synthetic Polynucleotide
atggccttaccagtgaccgccttgctcctgccgctggccttgctgctccacgccgccaggccggatatccagctcactcaaagcccctctagtctctctgcctcagtgggggatcgggtcagttttacttgtcaagcttcacaggatatcaacaacttccttaattggtatcagcagaagccaggaaaagcacccaagctgctcatctatgatgcctcaaatttggagacgggtgttcccagtcgattctctgggtcagggtccgggaccgactttacgtttacgatctcctctctgcagcccgaagacatcgccacatactattgtcaacagtacggcaacttgcctttcacatttgggggcgggactaaggttgaaatcaagaggggcggaggcggaagtggaggcggaggatctggcggcggaggctctcaggtacagctgcaggaatctgggcccggacttgtcaagccaagtcagacactttctcttacatgtaccgtgagcggcggaagtataagcagtggaggcttttactggtcttggatacggcagcacccaggcaaaggcttggagtggattggatacattcatcattcaggatctacacactataatccatcccttaagtcccgggtcaccattagcattgatacgtctaagaatctgttcagtctcaggctgtcctccgtcactgctgccgacacagccgtgtactactgcgcctccttggtttactgcggaggcgactgttatagcggctttgattattgggggcaggggaccctcgtaaccgtgagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2165 - DNA, 1077 bp, Artificial Sequence
  Synthetic Polynucleotide
atggccttaccagtgaccgccttgctcctgccgctggccttgctgctccacgccgccaggccggacttcgtgatgacacagagccctctgagcctgcctgtgacacctggcgaacctgccagcatcagctgtagaagcagccagagcatcgtgcacagcaacggcaacacctacctggaatggtatctccagaagcctggacagagcccacagctgctgatctacaaggtgtccaacagattcagcggcgtgcccgacagattttctggcagcggctctggcaccgacttcaccctgaagattagcagagtggaagccgaggacgtgggcgtgtactactgcttccaaggctctcacgtgcccctgacctttggacagggcaccaagctggaaatcaagagaggcggaggcggaagtggaggcggaggatctggcggcggaggctctgaagtgcagctggttgaaagcggagccgaagtgaagaaacctggggcctctgtgaaggtgtcctgcaaggccagcggctacacctttaccagctactggattcactgggtccgacaggcccctggacaaggacttgagtggatgggcgagaacgacccctccaacggcaggaccaactacaacgagaagttcaagaaccgcgtgaccctgaccgtggacaccagcatctctaccgcctacatggaactgagccggctgagatccgatgacaccgccgtgtactattgcgccagaggacccaactacttttacagcatggactactggggccagggcacaatggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2166 - DNA, 1068 bp, Artificial Sequence
  Synthetic Polynucleotide
atggccttaccagtgaccgccttgctcctgccgctggccttgctgctccacgccgccaggccggagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcggcggaggcggaagtggaggcggaggatctggcggcggaggctctcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2167 - DNA, 1068 bp, Artificial Sequence
  Synthetic Polynucleotide
atggccttaccagtgaccgccttgctcctgccgctggccttgctgctccacgccgccaggccgcagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcggcggaggcggaagtggaggcggaggatctggcggcggaggctctgagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2168 - DNA, 1086 bp, Artificial Sequence
  Synthetic Polynucleotide
atggccttaccagtgaccgccttgctcctgccgctggccttgctgctccacgccgccaggccggacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggggcggaggcggaagtggaggcggaggatctggcggcggaggctctcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2169 - DNA, 1086 bp, Artificial Sequence
  Synthetic Polynucleotide
atggccttaccagtgaccgccttgctcctgccgctggccttgctgctccacgccgccaggccgcaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcggcggaggcggaagtggaggcggaggatctggcggcggaggctctgacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2170 - DNA, 1056 bp, Artificial Sequence
  Synthetic Polynucleotide
atggccttaccagtgaccgccttgctcctgccgctggccttgctgctccacgccgccaggccggacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaggcggaggcggaagtggaggcggaggatctggcggcggaggctctcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2171 - DNA, 1056 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctggcggaggcggaagtggaggcggaggatctggcggcggaggctctgacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2172 - DNA, 1033 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagcgattacctggcttggtatcagcagaagcccggacaggctcccagactgctgatctacggtgcctctagcagagccacaggcatccccgatagattttctggcagcggctccggcaccgacttcaccctgacaattagcagactgcccgaggacttcgccgtgtactactgccagcagtacgtgtcctactggacctttggcggaggcaccaaggtggaaatcaaaagaacagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2173 - DNA, 1033 bp, Artificial Sequence; identical to SEQ ID NO: 2172
  Synthetic Polynucleotide

SEQ ID NO: 2174 - DNA, 1045 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtggcggaggcggaagtggaggcggaggatctggcggcggaggctctgagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaacagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2175 - DNA, 1045 bp, Artificial Sequence; identical to SEQ ID NO: 2174
  Synthetic Polynucleotide

SEQ ID NO: 2176 - DNA, 1071 bp, Artificial Sequence
  Synthetic Polynucleotide
atggccttaccagtgaccgccttgctcctgccgctggccttgctgctccacgccgccaggccggacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaggcggaggcggaagtggaggcggaggatctggcggcggaggctctcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2177 - DNA, 1071 bp, Artificial Sequence
  Synthetic Polynucleotide
atggccttaccagtgaccgccttgctcctgccgctggccttgctgctccacgccgccaggccgcaactgcaactgcaagagtctggccctggcctggtcaagcctagcgaaacactgagcctgacctgtaccgtgtctggcggcagcatcagctccagcacatattactggggctggatcagacagcctcctggcaaaggactggaatggatcggctccatctacttcaccggcagcaccgactacaaccccagcctgaagtccagggtgtccatctccgtggacaccagcaagaaccagttctccctgaagctgagcagcgtgacagccgctgataccgccgtgtactactgcgccaaagaggacgatagcagcggctactacagcttcgactattggggccagggcaacctggtcaccgttagctctggcggaggcggaagtggaggcggaggatctggcggcggaggctctgacatccaactgactcagagccccagctttctgagcgcctctgtgggcgacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcaagtgaacagctaccctctgacctttggcggaggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2178 - DNA, 1080 bp, Artificial Sequence
  Synthetic Polynucleotide
atggccttaccagtgaccgccttgctcctgccgctggccttgctgctccacgccgccaggccgcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaggcggaggcggaagtggaggcggaggatctggcggcggaggctctcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2179 - DNA, 1080 bp, Artificial Sequence
  Synthetic Polynucleotide
atggccttaccagtgaccgccttgctcctgccgctggccttgctgctccacgccgccaggccgcaagttcagctggtgcagtctggcagcgagctgaagaaacctggggcctctgtgaaggtgtcctgcaaggcttccggctacaccttcaacacctacgccatgaattgggtccgacaggctccaggccaaggactggaatggatgggctggatcaacaccaacaccggcaatcccacatacgcccagggcttcaccggcagattcgtgttctctctggacacctccgtgtccaccgcctacctccagatcagctctctgaaggccgaggataccgccgtgtactactgcgccagacggtacttcgattggctgctgggagccttcgacatctggggccagggaacaatggtcaccgtgtctagtggcggaggcggaagtggaggcggaggatctggcggcggaggctctcagtctgctctgacccagcctagatccgtgtctggctctcctggacacagcgtgaccatcagctgtaccggcacctcttccgacgtgggcgactacaattacgtgtcctggtatcagcagaggcccggcaaggtgccaaagctgctgatctacgacgtgtccaagaggccaagcggcgtgcccgatagattttccggcagcaagtctggcaacaccgccagcctgacaatctctggactgcaagccgaggacgaggccatctacttttgtgccagctacgccggcaactacaacgtggtgtttggcggaggcaccaagctgacagtgcttggacaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2180 - DNA, 1056 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaggcggaggcggaagtggaggcggaggatctggcggcggaggctctcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2181 - DNA, 1056 bp, Artificial Sequence
  Synthetic Polynucleotide
atggccttaccagtgaccgccttgctcctgccgctggccttgctgctccacgccgccaggccgcaagttcagcttgttcagagcggagccgaagtgaagaaacccggcagctctgtgaaggtgtcctgcaaggcttccggctacgcctttagcagcagctggatgaactgggtccgacaggctcctggacagggccttgaatggatgggcagaatctatcccggcgacggcaatacccactacgcccagaaattccagggccgcgtgacactgacagccgacaagtctacaagcaccgcctacatggaactgagcagcctgagaagcgaggacaccgccgtgtactattgcggcgaaggctatctggaccctatggactattggggccagggcacactggtcaccgttagctctggcggaggcggaagtggaggcggaggatctggcggcggaggctctgacatccagatgacacagagccctagcagcctgtctgccagcgtgggagacagagtgaccatcacatgtagcgccagccagggcatcaacaactacctgaactggtatcagcagaagcccggcaaggcccctaagctgctgatccactacacatctggactgcacgctggcgtgcccagcagattttctggctctggcagcggcaccgactacaccctgacaatatctagcctccagcctgaggacgtggcaacctactactgccagcagtacagcatcctgccttggacctttggcggaggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2182 - DNA, 1080 bp, Artificial Sequence
  Synthetic Polynucleotide
atggccttaccagtgaccgccttgctcctgccgctggccttgctgctccacgccgccaggccggacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaggcggaggcggaagtggaggcggaggatctggcggcggaggctctcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2183 - DNA, 1080 bp, Artificial Sequence
  Synthetic Polynucleotide
atggccttaccagtgaccgccttgctcctgccgctggccttgctgctccacgccgccaggccgcaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctggcggaggcggaagtggaggcggaggatctggcggcggaggctctgacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2184 - DNA, 1065 bp, Artificial Sequence
  Synthetic Polynucleotide
atggccttaccagtgaccgccttgctcctgccgctggccttgctgctccacgccgccaggccggacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggggcggaggcggaagtggaggcggaggatctggcggcggaggctctgaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2185 - DNA, 1065 bp, Artificial Sequence
  Synthetic Polynucleotide
atggccttaccagtgaccgccttgctcctgccgctggccttgctgctccacgccgccaggccggaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctggcggaggcggaagtggaggcggaggatctggcggcggaggctctgacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2186 - DNA, 1056 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2187 - DNA, 1056 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctggcggaggcggaagtggaggcggaggatctggcggcggaggctctgacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2188 - DNA, 1056 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttggcggaggcggaagtggaggcggaggatctggcggcggaggctctgaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2189 - DNA, 1056 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctggcggaggcggaagtggaggcggaggatctggcggcggaggctctgacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2190 - DNA, 1080 bp, Artificial Sequence
  Synthetic Polynucleotide
atggccttaccagtgaccgccttgctcctgccgctggccttgctgctccacgccgccaggccgcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcggcggaggcggaagtggaggcggaggatctggcggcggaggctctcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2191 - DNA, 1080 bp, Artificial Sequence
  Synthetic Polynucleotide
atggccttaccagtgaccgccttgctcctgccgctggccttgctgctccacgccgccaggccgcaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctggcggaggcggaagtggaggcggaggatctggcggcggaggctctcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2192 - DNA, 1101 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttggcggaggcggaagtggaggcggaggatctggcggcggaggctctgaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2193 - DNA, 1101 bp, Artificial Sequence
  Synthetic Polynucleotide
atggccttaccagtgaccgccttgctcctgccgctggccttgctgctccacgccgccaggccggaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctggcggaggcggaagtggaggcggaggatctggcggcggaggctctgacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcctga

SEQ ID NO: 2194 - DNA, 1017 bp, Artificial Sequence
  Synthetic Polynucleotide
atggccttaccagtgaccgccttgctcctgccgctggccttgctgctccacgccgccaggccggtcgtgatgacccagacccctctgagcctgagcgtgacactgggacagcctgccagcatcagctgcaagagcagccagagcctgctgcacagcgacggcaagacctacctgaactggctgcagcagaggccaggccagagccctcggagactgatctacctggtgtccaagctggacagcggcgtgcccgatagattttccggctctggcagcggcaccgacttcaccctgaagatcagccgggtggaagccgaggacgtgggcatctactactgttggcagggcacccacctgtggacctttggcggcggaacaaaggtggaaatcaagggcggaggcggaagtggaggcggaggatctggcggcggaggctctgaagtgcacctggtggaaagcggcggaggactggtgcagccagggggatctctgagactgtcttgtgccgccagcggcttcaccttcagcagatacggcatgagctgggtgcgccaggcccctggaaaaggactggaactggtggctatgatgaagaccaagggcggcagaacctactaccccgacagcgtgaagggccggttcaccatctcccgggacaacgccaagaacagcctgtacctgcagatgaactccctgcgggccgaggacaccgccatctactattgtgcctccgacggctactactggggccagggaacaaccgtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2195 - DNA, 1026 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagcgccaccagcagcgtgtcctacatgcactggtatcagcagaagcccggcaaggcccctaagcggtggatctacgataccagcaaactggcctctggcgtgcccagcagattttctggctctggcagcggcaccgagttcaccctgacaatatctagcctccagcctgaggacttcgccacctactactgccagcagtggtccagcaatcccctgacctttggacagggcaccaagctggaaatcaaaggcggaggcggaagtggaggcggaggatctggcggcggaggctctcaagttcagctggttcagtctggggccgaagtgaagaaacctggggcctctgtgaaggtgtcctgcaaggccagcggctacaagttcaccagctacgtgatgcactgggtccgacaggctccaggacaaggactggaatggatcggctacatcaacccctacaacgacgtgaccaagtacaacgagaagttcaagggcagagtgaccatcaccgccgacaagagcacaagcaccgcctacatggaactgagcagcctgagaagcgaggacaccgccgtgcactattgtgccagaggcagctactacgactacgacggctttgtgtattggggccagggcaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2196 - DNA, 1041 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagagcctgctgaacagccggaccagaaagaactacctggcctggtatcagcagaagcccggacagtctcccaagctgctgatctactggaccagcaccagaaagtccggcgtgcccgatagattttctggctctggcagcggcaccgacttcaccctgacaatttctagcctgcaagccgaggacgtggccgtgtactactgcaagcagagcttcatcctgcggacctttggccagggcaccaaggtggaaatcaaaggcggaggcggaagtggaggcggaggatctggcggcggaggctctgaagttcagctggttcagagcggagccgaagtgaagaaacctggggcctctgtgaaggtgtcctgcaaggcttccggcttcaccttcaccagctactacatccactgggtccgacaggcccctggacaaggactggaatggatcggctggatctaccccgagaacgacaacaccaagtacaacgagaagttcaaggaccgcgtgaccatcaccgccgataccagcacaagcaccgcctacctggaactgagcagcctgagaagcgaggacaccgccgtgtattattgcgccagagatgcctacagccggtactacttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2197 - DNA, 1050 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagactgctgagcagctacggccacacatacctgcactggtatctccagaagcctggacagagcccacagctgctgatctacgaggtgtccaacagattcagcggcgtgcccgatagattttccggctctggcagcggcaccgacttcaccctgaagattagcagagtggaagccgaggacgtgggcgtgtactactgtagccagagcacacacgtgcccctgacctttggacagggcaccaaggtggaaatcaaaggcggaggcggaagtggaggcggaggatctggcggcggaggctctgaagtgcagctggttgaatctggcggcggactggttaagcctggcggatctctgagactgagctgtgccgccagcggctacaccttcagcaattactggatcggctgggtccgacaggcccctggaaaaggactggaatggatcggcgacatctaccctggcggcaactacatcagaaacaacgagaagttcaaggacaagaccacactgagcgccgacaccagcaagaacacagcctacctccagatgaacagcctgaaaaccgaggacaccgccgtgtactattgcggcagcagcttcggcagcaactacgtgttcgcctggttcacctattggggccagggcacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2198 - DNA, 1044 bp, Artificial Sequence
  Synthetic Polynucleotide
atggccttaccagtgaccgccttgctcctgccgctggccttgctgctccacgccgccaggccggacatcgtgatgtctcagagccctagcagcctggctgtgtccgctggcgagaaagtgaccatgagctgcaagagcagccagagcctgttcaacagccggaccagaaagaactacctggcctggtatcagcagaagcccggacagtctcccaagctgctgatctactgggccagcgccagagatagcggagtgcctgctagattcacaggcagcggcagcgagacatacttcaccctgaccatcagcagagtgcaggccgaggatctggccgtgtactactgtatgcagagcttcaacctgcggaccttcggcggaggcaccaagctggaaatcaaaggcggaggcggaagtggaggcggaggatctggcggcggaggctctgaagtgaacctggttgaatccggcggaggactggttcagcctggcggatctctgagactgagctgtgccaccagcggcttcaccttcaccgacaactacatgagctgggtccgacagcctcctggcaaagctctggaatggctgggcttcatcagaaacaaggccaacggctacaccaccgactacagcgcctctgtgcggggcagattcaccatctccagagacaacagccagtccatcctgtacctccagatgaacgccctgagagccgaggatagcgccacctactactgtgccagagatgtgggcagcaactacttcgactattggggccagggcaccacactgaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2199 - DNA, 1047 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctcggcgagcgcgtgacaatgaattgcaagagcagccagagcctgctgtactccaccaaccagaagaactacctggcctggtatcagcagaagcccggacagtctcccaagctgctgatctactgggccagcaccagagaaagcggcgtgcccgatagattttctggctctggcagcggcaccgacttcaccctgacaatcagttctgtgcaggccgaggacgtggccgtgtactactgccagcagtattacagctaccggaccttcggcggaggcaccaagctggaaatcaaaggcggaggcggaagtggaggcggaggatctggcggcggaggctctcaagttcagctccagcagtctggccccgagtggaaacctggcgcttctgtgaagatgagctgcaaggccagcggctacaccttcaccagctacgtgatccactgggtccgacagaagcctggccaaggactggattggatcggctacatcaacccctacaacgacggcaccgattacgacgagaagttcaagggcaaagccacactgaccagcgacaccagcacaagcaccgcctacatggaactgagcagcctgagaagcgaggacaccgccgtgtattattgcgccagagagaaggacaactacgccaccggcgcttggtttgcctattggggccagggaacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2200 - DNA, 1035 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatcagaaactacctgaactggtatcagcagaagcccggcaaggcccctaagctgctgatctactacaccagcagactggaaagcggcgtgcccagcagattttctggcagcggctctggcaccgactacaccctgacaatatccagcctccagcctgaggacttcgccacctactattgccagcagggcaacaccctgccttggacatttggccagggcaccaaggtggaaatcaaaggcggaggcggaagtggaggcggaggatctggcggcggaggctctgaagtgcagctggttgaatcaggtggcggcctggttcaacctggcggatctctgagactgagctgtgccgccagcggctacagctttaccggctacaccatgaactgggtccgacaggcccctggcaaaggactggaatgggtcgccctgattaacccctacaagggcgtgtccacctacaaccagaagttcaaggacaggttcaccatcagcgtggacaagagcaagaacaccgcctacctccagatgaactccctgagagccgaggacaccgccgtgtactattgtgccagaagcggctactacggcgacagcgactggtactttgatgtgtggggccagggaaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2201 - DNA, 1041 bp, Artificial Sequence
  Synthetic Polynucleotide
atggccttaccagtgaccgccttgctcctgccgctggccttgctgctccacgccgccaggccgagcacaggatctcaggtgcagctccagcagtctggccctgagcttgtgaaacctggcgcttccgtgaagatgagctgcaaggccagcggctacaccttcaccgactatgtgattaactggggcaagcagcggagcggccaaggactggaatggatcggcgaaatctaccctggcagcggcaccaactactacaacgagaagttcaaggccaaggccacactgaccgccgacaagagcagcaatatcgcctacatgcagctgagcagcctgaccagcgaagatagcgccgtgtacttctgcgccagaagaggcagatacggcctgtacgctatggactattggggccagggcaccagcgtgacagtgtcatctggcggaggcggaagtggaggcggaggatctggcggcggaggctctgacatccagatgacccagacaaccagcagcctgtctgccagcctgggcgatagagtgaccatcagctgtagagccagccaggacatcagcaactacctgaactggtatcagcagaaacccgacggcaccgtgaagctgctgatctactacaccagcagactgcacagcggcgtgcccagcagattttctggctctggaagcggcacagattactccctgaccatcaacaacctggaacaagaggacattgccacctacttttgccagcaaggcaacacccggccttggacatttggcggaggcaccaagctggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2202 - DNA, 1026 bp, Artificial Sequence
  Synthetic Polynucleotide
atggccttaccagtgaccgccttgctcctgccgctggccttgctgctccacgccgccaggccgcagatcgtgctgacacagagccctgccatcatgagcgcttccccaggcgagaaagtgaccatgacctgtagcgccacaagcagcgtgtcctacatgcactggtatcagcagaagtccggcacaagccccaagcggtggatctacgataccagcaaactggcctctggcgtgcccgctagattttctggctctggcagcggcaccagctacagcctgacaatcagcagcatggaagccgaggatgccgccacctactactgccagcagtggtccagcaatcccctgacatttggagccggcaccaagctggaactgaaaggcggaggcggaagtggaggcggaggatctggcggcggaggctctgaagttcagctccagcagtctggccccgagcttgtgaaacctggcgcttccgtgaagatgagctgcaaggccagcggctacaagttcacctcctacgtgatgcactgggtcaagcagaaacccggccagggccttgagtggatcggctacatcaacccctacaacgacgtgaccaagtacaacgagaagttcaagggcaaagccacactgaccagcgacaagagcagcagcaccgcctacatggaactgagcagcctgacctctgaggacagcgccgtgcactattgtgccagaggcagctactacgactacgacggctttgtgtattggggccagggcaccctggttaccgtttctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2203 - DNA, 1029 bp, Artificial Sequence
  Synthetic Polynucleotide
atggccttaccagtgaccgccttgctcctgccgctggccttgctgctccacgccgccaggccggacatccagatgacacagagccctgccagccagtctgcctctctgggagagtctgtgaccatcacctgtctggcctctcagaccatcggaacatggctggcctggtatcagcagaagcctggcaagtctccccagctgctgatctacgccgctacatctctggctgatggcgtgcccagcagattttctggcagcggctccggcaccaagttcagcctgaagatcagaaccctccaggccgaggacttcgtgtcctactattgccagcagctgtactccaagccttacacctttggcggaggcaccaagctggaaatcaagagaggcggaggcggaagtggaggcggaggatctggcggcggaggctctgaagttcagctgcaacagagcggagccgagctggttaagcctggcgcttctgtgaagctgagctgtacccctagcggcttcaacgtgaaggacacctacatccactgggtcaagcagcggcctaagcagggcctcgaatggatcggaagaatcgaccctagcgacggcgacattaagtacgaccccaagttccagggcaaagccaccatcaccgccgacaccagcagcaacacagtgtctctccagctgagcagcctgaccagcgaagataccgccgtgtactattgcgcccgttggttcggcgattacggggccatgaattattggggccagggcaccagcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacactaatgctacaaccaaagctgcggggggagctttgcagtctacagcctcactcttcgttgtaagccttagcctgttgcacctctactcc

SEQ ID NO: 2204 - skipped

SEQ ID NO: 2205 - DNA, 1338 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2206 - DNA, 1338 bp, Artificial Sequence
  Synthetic Polynucleotide
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2207 - DNA, 1338 bp, Artificial Sequence
  Synthetic Polynucleotide
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2208 - DNA, 1341 bp, Artificial Sequence
  Synthetic Polynucleotide
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2209 - DNA, 1362 bp, Artificial Sequence
  Synthetic Polynucleotide
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2210 - DNA, 1413 bp, Artificial Sequence
  Synthetic Polynucleotide
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2211 - DNA, 1344 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2212 - DNA, 1341 bp, Artificial Sequence
  Synthetic Polynucleotide
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2213 - DNA, 1359 bp, Artificial Sequence
  Synthetic Polynucleotide
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2214 - DNA, 1374 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2215 - DNA, 1335 bp, Artificial Sequence
  Synthetic Polynucleotide
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2216 - DNA, 1365 bp, Artificial Sequence
  Synthetic Polynucleotide
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2217 - DNA, 1338 bp, Artificial Sequence
  Synthetic Polynucleotide
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2218 - DNA, 1350 bp, Artificial Sequence
  Synthetic Polynucleotide
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2219 - DNA, 1344 bp, Artificial Sequence
  Synthetic Polynucleotide
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2220 - DNA, 1344 bp, Artificial Sequence
  Synthetic Polynucleotide
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2221 - DNA, 1347 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2222 - DNA, 1341 bp, Artificial Sequence
  Synthetic Polynucleotide
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2223 - DNA, 1374 bp, Artificial Sequence
  Synthetic Polynucleotide
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2224 - DNA, 1341 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2225 - DNA, 1344 bp, Artificial Sequence
  Synthetic Polynucleotide
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2226 - DNA, 1347 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2227 - DNA, 1347 bp, Artificial Sequence
  Synthetic Polynucleotide
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2228 - DNA, 1347 bp, Artificial Sequence; identical to SEQ ID NO: 2227
  Synthetic Polynucleotide

SEQ ID NO: 2229 - DNA, 1347 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2230 - DNA, 1353 bp, Artificial Sequence
  Synthetic Polynucleotide
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2231 - DNA, 1344 bp, Artificial Sequence
  Synthetic Polynucleotide
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2232 - DNA, 1353 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2233 - DNA, 1347 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2234 - DNA, 1344 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2235 - DNA, 1374 bp, Artificial Sequence
  Synthetic Polynucleotide
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2236 - DNA, 1350 bp, Artificial Sequence
  Synthetic Polynucleotide
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2237 - DNA, 1344 bp, Artificial Sequence; identical to SEQ ID NO: 2234
  Synthetic Polynucleotide

SEQ ID NO: 2238 - DNA, 1341 bp, Artificial Sequence
  Synthetic Polynucleotide
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2239 - DNA, 1347 bp, Artificial Sequence
  Synthetic Polynucleotide
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2240 - DNA, 1341 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2241 - DNA, 1356 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2242 - DNA, 1332 bp, Artificial Sequence
  Synthetic Polynucleotide
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2243 - DNA, 1350 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2244 - DNA, 1350 bp, Artificial Sequence
  Synthetic Polynucleotide
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2245 - DNA, 1329 bp, Artificial Sequence
  Synthetic Polynucleotide
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2246 - DNA, 1344 bp, Artificial Sequence
  Synthetic Polynucleotide
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2247 - DNA, 1335 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2248 - DNA, 1365 bp, Artificial Sequence
  Synthetic Polynucleotide
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2249 - DNA, 1353 bp, Artificial Sequence
  Synthetic Polynucleotide
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2250 - DNA, 1431 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2251 - DNA, 1428 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2252 - DNA, 1476 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2253 - DNA, 1344 bp, Artificial Sequence
  Synthetic Polynucleotide
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2254 - DNA, 1341 bp, Artificial Sequence
  Synthetic Polynucleotide
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2255 - DNA, 1332 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2256 - DNA, 1362 bp, Artificial Sequence
  Synthetic Polynucleotide
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2257 - DNA, 1323 bp, Artificial Sequence
  Synthetic Polynucleotide
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2258 - DNA, 1347 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2259 - DNA, 1335 bp, Artificial Sequence
  Synthetic Polynucleotide
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2260 - DNA, 1347 bp, Artificial Sequence
  Synthetic Polynucleotide
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2261 - DNA, 1335 bp, Artificial Sequence
  Synthetic Polynucleotide
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2262 - DNA, 1359 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2263 - DNA, 1344 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2264 - DNA, 1356 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2265 - DNA, 1356 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2266 - DNA, 1338 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2267 - DNA, 1344 bp, Artificial Sequence
  Synthetic Polynucleotide
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2268 - DNA, 1335 bp, Artificial Sequence
  Synthetic Polynucleotide
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2269 - DNA, 1338 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2270 - DNA, 1326 bp, Artificial Sequence
  Synthetic Polynucleotide
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2271 - DNA, 1419 bp, Artificial Sequence
  Synthetic Polynucleotide
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2272 - DNA, 1332 bp, Artificial Sequence
  Synthetic Polynucleotide
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2273 - DNA, 1359 bp, Artificial Sequence
  Synthetic Polynucleotide
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2274 - DNA, 1371 bp, Artificial Sequence
  Synthetic Polynucleotide
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2275 - DNA, 1344 bp, Artificial Sequence
  Synthetic Polynucleotide
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2276 - DNA, 1329 bp, Artificial Sequence
  Synthetic Polynucleotide
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2277 - DNA, 1338 bp, Artificial Sequence
  Synthetic Polynucleotide
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2278 - DNA, 1323 bp, Artificial Sequence
  Synthetic Polynucleotide
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2279 - DNA, 1353 bp, Artificial Sequence
  Synthetic Polynucleotide
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 2280 - DNA, 1329 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcggaggaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

(The sequence listing continues in the following parts.)

What is claimed is:

1. A method for reducing the insertion of a nucleic acid encoding an antigen binding receptor (ABR) into a cell expressing an antigen that is targeted by the ABR comprising contacting the cell with a viral vector comprising a nucleic acid encoding the ABR, wherein the ABR is present on an envelope of the viral vector, in the presence of an exogenous inhibitory agent, wherein the exogenous inhibitory agent interferes with the interaction of an antigen binding domain of the ABR and the antigen thereby reducing insertion of the nucleic acid encoding the ABR into the cell expressing the antigen.

2. The method of claim 1, wherein the exogenous inhibitory agent is a soluble cognate of the antigen binding domain, a soluble binding domain having a specificity to the antigen, Protein L or a fragment thereof that binds to k light chains of the antigen binding domain of the ABR, an anti-idiotype antibody or fragment thereof that binds to the antigen binding domain of the ABR, or a soluble form of the antigen or a fragment thereof.

3. The method of claim 1, wherein the exogenous inhibitory agent comprises an antibody, a Fv, a Fab, a (Fab')2, a heavy chain variable region of an antibody (vH domain), a light chain variable region of an antibody (vL domain), a single domain antibody, a single chain variable fragment (scFv), a monomeric variable region of an antibody, a camelid vHH domain, a non-immunoglobulin antigen binding domain, a ligand, or a fragment thereof having specificity to the same antigen.

4. The method of claim 2, wherein the cell is incubated with the inhibitory agent prior to and/or concurrent with contacting the cell with the viral vector.

5. The method of claim 1, wherein the cell is a disease causing or disease associated cell, or a normal healthy cell.

6. The method of claim 1, wherein the viral vector is a lentivirus or a γ-retrovirus.

7. The method of claim 1, wherein the ABR is a chimeric antigen receptor (CAR), a T cell receptor fusion protein (TFP) or a trifunctional T cell antigen coupler (tri-TAC).

8. The method of claim 1, wherein the exogenous inhibitory agent binds to the same epitope, an overlapping epitope or a different epitope on the antigen as the antigen binding domain of the ABR.

9. The method of claim 1, wherein the antigen is one or more of the group of antigens comprising: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8) aNeu5Ac(2-3)bDGa1p(1-4)bDG1cp(1-1)Cer); TNF receptor family member B cell maturation (BCMA); Tn antigen ((Tn Ag) or (Ga1NAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis (Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); ephrin type-A receptor 2 (EphA2); Fucosyl GM1; sialyl Lewis adhesion molecule (sLe); ganglioside GM3 (aNeu5Ac (2-3) bDCla1p (1-4) bDG1cp (1-1) Cer); transglutaminase 5 (TGS5); high molecular weight melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); angiopoietin-binding cell surface receptor 2 (Tie 2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b IGLL1, TCR gamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lewis AG, TCR-beta1 chain, TCR-beta2 chain, TCR-gamma chain, TCR-delta chain, Luteinizing hormone receptor (LHR), Follicle stimulating hormone receptor (FSHR), Chorionic Gonadotropin Hormone receptor (CGHR), CCR4, SLAMF6, SLAMF4, PDL1, Guanylyl cyclase C (GCC), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2), P-glycoprotein, STEAP1, LIV1, NECTIN-4, CRIPTO, GPA33, BST1/CD157, low conductance chloride channel and Integrin B7.

10. A composition comprising a viral vector comprising a nucleic acid encoding an antigen binding receptor (ABR), wherein the ABR is present on an envelope of the viral vector, and an inhibitory agent that interferes with the interaction of an antigen binding domain of the ABR and the antigen.

11. The composition of claim 10, wherein the exogenous inhibitory agent is a soluble cognate of the antigen binding domain, a soluble binding domain having a specificity to the antigen, Protein L or a fragment thereof that binds to k light chains of the antigen binding domain of the ABR, an anti-idiotype antibody or fragment thereof that binds to the antigen binding domain of the ABR, or a soluble form of the antigen or a fragment thereof.

12. The composition of claim 10, wherein the exogenous inhibitory agent comprises an antibody, a Fv, a Fab, a (Fab')2, a heavy chain variable region of an antibody (vH domain), a light chain variable region of an antibody (vL domain), a single domain antibody, a single chain variable fragment (scFv), a monomeric variable region of an antibody, a camelid vHH domain, a non-immunoglobulin antigen binding domain, a ligand, or a fragment thereof having specificity to the same antigen.

13. The composition of claim 10, wherein the viral vector is a lentivirus or a γ-retrovirus.

14. The composition of claim 10, wherein the ABR is a chimeric antigen receptor (CAR), a T cell receptor fusion protein (TFP) or a trifunctional T cell antigen coupler (tri-TAC).

15. The composition of claim 10, wherein the antigen is one or more of the antigens selected from the group of antigens comprising: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3) bDGa1p(1-4)bDG1cp(1-1)Cer); TNF receptor family member B cell maturation (BCMA); Tn antigen ((Tn Ag) or (Ga1NAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis (Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2;

fibroblast activation protein alpha (FAP); insulin-like growth factor 1 receptor (IGF-I receptor), carbonic anhydrase IX (CAIX); ephrin type-A receptor 2 (EphA2); Fucosyl GM1; sialyl Lewis adhesion molecule (sLe); ganglioside GM3 (aNeu5Ac(2-3)bDClalp(1-4)bDG1cp(1-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); angiopoietin-binding cell surface receptor 2 (Tie 2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGLIHIGLL1, TCR gamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lewis AG, TCR-beta1 chain, TCR-beta2 chain, TCR-gamma chain, TCR-delta chain, Luteinizing hormone receptor (LHR), Follicle stimulating hormone receptor (FSHR), Chorionic Gonadotropin Hormone receptor (CGHR), CCR4, SLAMF6, SLAMF4, PDL1, Guanylyl cyclase C (GCC), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2), P-glycoprotein, STEAP1, LIV1, NECTIN-4, CRIPTO, GPA33, BST1/CD157, low conductance chloride channel and Integrin B7.

16. A method for reducing the insertion of a nucleic acid encoding an antigen binding receptor (ABR) into a cell expressing an antigen that is targeted by the ABR, wherein a viral vector comprising the nucleic acid encoding the ABR is produced using packaging cells, the method comprising one or more of the following options:

(a) contacting the cell expressing the antigen with the viral vector comprising the nucleic acid encoding the ABR in the presence of an exogenous inhibitory agent, wherein the ABR is present on an envelope of the viral vector, and wherein the exogenous inhibitory agent interferes with the interaction between an antigen binding domain of the ABR and the antigen, wherein the cell expressing the antigen is contacted with the exogenous inhibitory agent before and/or during the step of contacting the cell expressing the antigen with the viral vector;

(b) reducing or eliminating expression of the ABR, wherein the ABR is expressed on a surface of the packaging cells that are used to produce the viral vector;

(c) co-expressing, in the packaging cells that are used to produce the viral vector, the antigen or a fragment thereof that is recognized by the antigen binding domain of the ABR, or a membrane-anchored binding molecule that binds to the antigen binding domain of the ABR, such that the ABR, wherein the ABR is expressed on a surface of the viral vector is bound by the co-expressed antigen, fragment thereof, or membrane-anchored binding molecule;

(d) reducing or eliminating expression of the ABR, wherein the ABR is expressed on an envelope of the viral vector;

thereby reducing the insertion of the nucleic acid encoding the ABR into the cell expressing the antigen.

17. The method of claim 16, wherein the method comprises option (a), and the exogenous inhibitory agent is Protein L or a fragment thereof that binds to k light chains of the antigen binding domain of the ABR, an anti-idiotype antibody or fragment thereof that binds to the antigen binding domain of the ABR, or a soluble form of the antigen or a fragment thereof.

18. The method of claim 16, wherein the method comprises option (c), and the membrane-anchored binding molecule of (c) is a membrane-anchored form of Protein L or a fragment thereof that binds to K light chains of an antibody, a membrane-anchored form of an anti-idiotype antibody targeting an scFv region of the ABR, or a membrane-anchored form of the antigen or a fragment thereof.

19. The method of claim 16, comprising two or more of options (a), (b), (c), and (d).

20. The method of claim 16, wherein the method comprises option (b) and/or (d), and the reducing or eliminating of expression of the ABR in (b) or (d) is achieved by controlling expression of the ABR at a transcriptional, post-transcriptional, translational, or post-translational level, or by inducing degradation of the ABR polypeptide.

21. The method of claim 16, wherein the method comprises option (a), and the viral vector is contacted with the cell the cell expressing the antigen and the exogenous inhibitory agent in the presence of an agent that enhances the transduction of the viral vector into the target cells.

22. The method of claim 16, wherein the viral vector a lentivirus or a γ-retrovirus.

23. The method of claim 16, wherein the cell expressing the antigen is a disease causing or disease associated cell, or a normal healthy cell.

24. The method of claim 16, wherein the antigen is one or more of the antigens selected from the group of antigens comprising: CD5, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bDGalp(1-4)bDG1cp(1-1) Cer); TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis (Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); ephrin type-A receptor 2 (EphA2); Fucosyl GM1; sialyl Lewis adhesion molecule (sLe); ganglioside GM3 (aNeu5Ac(2-3)bDClalp(1-4)bDGlcp(1-1) Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); angiopoietin-binding cell surface receptor 2 (Tie 2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGLL1, TCR gamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lewis AG, TCR-beta1 chain, TCR-beta2 chain, TCR-gamma chain, TCR-delta chain, Luteinizing hormone receptor (LHR), Follicle stimulating hormone receptor (FSHR), Chorionic Gonadotropin Hormone receptor (CGHR), CCR4, SLAMF6, SLAMF4, PDL1, Guanylyl cyclase C (GCC), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRC5D, claudin18.2 (CLD18A2 OR CLDN18A.2), P-glycoprotein, STEAP1, LIV1, NECTIN-4, CRIPTO, GPA33, BST1/CD157, low conductance chloride channel and Integrin B7.

25. The method of claim 16, wherein the ABR is a chimeric antigen receptor (CAR), a T cell receptor fusion protein (TFP) or a trifunctional T cell antigen coupler (tri-TAC).

26. The method of claim 21, wherein the agent that enhances the transduction of the viral vector into the target cells is polybrene or retronectin.

* * * * *